United States Patent
Cameron et al.

(10) Patent No.: US 12,227,776 B2
(45) Date of Patent: Feb. 18, 2025

(54) ENGINEERED CASCADE COMPONENTS AND CASCADE COMPLEXES

(71) Applicant: CARIBOU BIOSCIENCES, INC., Berkeley, CA (US)

(72) Inventors: Peter Sean Cameron, San Francisco, CA (US); Scott David Gradia, Albany, CA (US); Sanne Eveline Klompe, New York, NY (US); Samuel Henry Sternberg, New York, NY (US); Matthew Scott Thompson, San Francisco, CA (US)

(73) Assignee: Caribou Biosciences, Inc., Berkeley, CA (US)

( * ) Notice: Subject to any disclaimer, the term of this patent is extended or adjusted under 35 U.S.C. 154(b) by 938 days.

(21) Appl. No.: 17/120,081

(22) Filed: Dec. 11, 2020

(65) Prior Publication Data

US 2021/0102183 A1   Apr. 8, 2021

Related U.S. Application Data

(63) Continuation of application No. PCT/US2019/036864, filed on Jun. 12, 2019.

(60) Provisional application No. 62/684,735, filed on Jun. 13, 2018, provisional application No. 62/807,717, filed on Feb. 19, 2019.

(51) Int. Cl.
| | |
|---|---|
| *C12N 9/22* | (2006.01) |
| *C07K 7/06* | (2006.01) |
| *C07K 7/08* | (2006.01) |
| *C07K 14/00* | (2006.01) |
| *C12N 15/11* | (2006.01) |
| *C12N 15/113* | (2010.01) |
| *C12N 15/90* | (2006.01) |

(52) U.S. Cl.
CPC ............... *C12N 9/22* (2013.01); *C07K 7/06* (2013.01); *C07K 7/08* (2013.01); *C07K 14/00* (2013.01); *C12N 15/11* (2013.01); *C12N 15/113* (2013.01); *C12N 15/902* (2013.01); *C12N 15/907* (2013.01); *C07K 2319/00* (2013.01); *C07K 2319/09* (2013.01); *C07K 2319/21* (2013.01); *C07K 2319/22* (2013.01); *C07K 2319/50* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | | |
|---|---|---|---|
| 8,865,406 B2 | 10/2014 | Zhang et al. | |
| 8,993,233 B2 | 3/2015 | Zhang et al. | |
| 9,856,497 B2 | 1/2018 | Qi et al. | |
| 9,885,026 B2* | 2/2018 | Brouns | C12N 15/81 |
| 9,982,267 B2 | 5/2018 | Thomas et al. | |
| 10,227,576 B1* | 3/2019 | Cameron | C07K 14/00 |
| 10,329,547 B1* | 6/2019 | Cameron | C12N 9/22 |
| 10,435,678 B2* | 10/2019 | Brouns | C12N 15/82 |
| 10,457,922 B1* | 10/2019 | Cameron | C12N 15/907 |
| 10,597,648 B2* | 3/2020 | Cameron | C12N 15/11 |
| 10,711,257 B2* | 7/2020 | Brouns | C07K 14/245 |
| 10,781,432 B1* | 9/2020 | Cameron | C12N 15/907 |
| 10,954,498 B2* | 3/2021 | Brouns | A61K 48/005 |
| 11,555,181 B2* | 1/2023 | Cameron | C07K 7/06 |
| 11,807,869 B2 | 11/2023 | Mashimo et al. | |
| 2010/0076057 A1 | 3/2010 | Sontheimer et al. | |
| 2013/0130248 A1 | 5/2013 | Haurwitz et al. | |
| 2014/0186843 A1 | 7/2014 | Zhang et al. | |
| 2014/0294773 A1 | 10/2014 | Brouns et al. | |
| 2014/0295556 A1 | 10/2014 | Joung et al. | |
| 2014/0302563 A1 | 10/2014 | Doudna et al. | |
| 2014/0315985 A1 | 10/2014 | May et al. | |
| 2015/0044772 A1 | 2/2015 | Zhao | |
| 2015/0133315 A1 | 5/2015 | Jacobson et al. | |
| 2015/0152398 A1 | 6/2015 | Doudna et al. | |
| 2015/0376586 A1 | 12/2015 | May et al. | |
| 2016/0053272 A1 | 2/2016 | Wurtzel et al. | |
| 2016/0053304 A1 | 2/2016 | Wurtzel et al. | |
| 2016/0208243 A1 | 7/2016 | Zhang et al. | |
| 2016/0215300 A1 | 7/2016 | May et al. | |
| 2016/0345578 A1 | 12/2016 | Barrangou et al. | |
| 2016/0355796 A1 | 12/2016 | Davidson et al. | |
| 2017/0028083 A1 | 2/2017 | Beisel et al. | |
| 2017/0080107 A1 | 3/2017 | Chivukula et al. | |
| 2017/0151282 A1 | 6/2017 | Discher et al. | |

(Continued)

FOREIGN PATENT DOCUMENTS

| | | |
|---|---|---|
| CA | 2944978 | 10/2015 |
| WO | WO 2013098244 | 7/2013 |

(Continued)

OTHER PUBLICATIONS

Singh et al. Curr Protein Pept Sci. 2017, 18, 1-11 (Year: 2017).*
Chica et al. Curr Opin Biotechnol. Aug. 2005;16(4):378-84. (Year: 2005).*
Beloglazova, N., et al., "Structure and activity of the Cas3 HD nuclease MJ0384, an effector enzyme of the CRISPR interference," EMBO Journal 30(22):4616-4627 (2011; doi:10.1038/emboj.2011.377).
Beloglazova, N., et al., "CRISPR RNA binding and DNA target recognition by purified Cascade complexes from *Escherichia coli*," Nucleic Acids Research 43(1):530-543 (2015; doi:10.1093/nar/gku1285).

(Continued)

*Primary Examiner* — Christian L Fronda
(74) *Attorney, Agent, or Firm* — Olga Zimmerman

(57) ABSTRACT

The present disclosure provides engineered Class 1 Type I CRISPR-Cas (Cascade) systems that comprise multi-protein effector complexes, nucleoprotein complexes comprising Type I CRISPR-Cas subunit proteins and nucleic acid guides, polynucleotides encoding Type I CRISPR-Cas subunit proteins, and guide polynucleotides. Also, disclosed are methods for making and using the engineered Class 1 Type I CRISPR-Cas systems of the present invention.

15 Claims, 72 Drawing Sheets

Specification includes a Sequence Listing.

(56) References Cited

U.S. PATENT DOCUMENTS

| | | |
|---|---|---|
| 2017/0204372 A1 | 7/2017 | Mohler et al. |
| 2017/0239370 A1 | 8/2017 | Zhu et al. |
| 2017/0260546 A1 | 9/2017 | Qimron et al. |
| 2017/0283779 A1 | 10/2017 | Holder et al. |
| 2018/0044659 A1 | 2/2018 | Zhu et al. |
| 2018/0049984 A1 | 2/2018 | Brinker et al. |
| 2018/0112228 A1 | 4/2018 | Ecker et al. |
| 2018/0112255 A1 | 4/2018 | Chen et al. |
| 2018/0119121 A1 | 5/2018 | Brouns et al. |
| 2018/0127745 A1 | 5/2018 | Konermann et al. |
| 2018/0148506 A1 | 5/2018 | Png et al. |
| 2018/0148711 A1 | 5/2018 | Finer et al. |
| 2018/0155729 A1 | 6/2018 | Beisel et al. |
| 2018/0161368 A1 | 6/2018 | Odegard |
| 2018/0179522 A1 | 6/2018 | Buckley et al. |
| 2018/0223291 A1 | 8/2018 | Holder et al. |
| 2018/0253563 A1 | 9/2018 | Peck et al. |
| 2018/0273962 A1 | 9/2018 | Kerstetter et al. |
| 2018/0305424 A1 | 10/2018 | Crabtree et al. |
| 2018/0334688 A1 | 11/2018 | Gersbach et al. |

FOREIGN PATENT DOCUMENTS

| | | |
|---|---|---|
| WO | WO 2014018423 | 1/2014 |
| WO | WO 2014093479 | 6/2014 |
| WO | WO 2015155686 | 10/2015 |
| WO | WO 2016053397 | 4/2016 |
| WO | WO 2016077350 | 5/2016 |
| WO | WO 2017066497 | 4/2017 |
| WO | WO 2017219033 | 12/2017 |
| WO | PCT/US2019/036864 | 6/2019 |

OTHER PUBLICATIONS

Brouns, S., et al., "Small CRISPR RNAs Guide Antiviral Defense in Prokaryotes," Science 321(5891):960-964 (2008; doi:10.1126/science.1159689).

Chen, X., et al., "Fusion Protein Linkers: Property, Design and Functionality," Advanced drug delivery reviews 65(10):1357-1369 (2013; doi:10.1016/j.addr.2012.09.039).

Chichili, V., et al., "Linkers in the structural biology of protein-protein interactions," Protein Science: A Publication of the Protein Society 22(2):153-167 (2013; doi: 10.1002/pro.2206).

Choudhury, R., et al., "Engineering RNA endonucleases with customized sequence specificities," Nat. Commun. 3:1147 (2012; doi: 10.1038/ncomms2154).

Fu, B., et al., "High-Throughput Characterization of Cascade type I-E CRISPR Guide Efficacy Reveals Unexpected PAM Diversity and Target Sequence Preferences," Genetics 206(4):1727-1738 (Aug. 1, 2017; doi.org/10.1534/genetics.117.202580).

George, R., et al., "An analysis of protein domain linkers: their classification and role in protein folding," Protein Eng. 15(11):871-9 (Nov. 2003).

Gleditzsch, D., et al., "Modulating the Cascade architecture of a minimal Type I-F CRISPR-Cas system," Nucleic Acids Research 44(12):5872-5882 (2016; doi:10.1093/nar/gkw469).

Guilinger, J,. et al., "Fusion of catalytically inactive Cas9 to FokI nuclease improves the specificity of genome modification," Nat Biotechnol. 32(6):577-582 (Jun. 2014; doi: 10.1038/nbt.2909; Epub Apr. 25, 2014).

Hochstrasser, M., et al., "DNA Targeting by a Minimal CRISPR RNA-Guided Cascade," Molecular cell 63(5):840-851 (2016; doi:10.1016/j.molcel.2016.07.027).

Huo, Y., et al., "Structures of CRISPR Cas3 offer mechanistic insights into Cascade-activated DNA unwinding and degradation," Nature structural & molecular biology 21(9):771-777 (2014; doi:10.1038/nsmb.2875).

Jackson, R., et al., "Crystal structure of the CRISPR RNA—guided surveillance complex from *Escherichia coli*," Science 345(6203):1473-9 (Sep. 19, 2014; doi:10.1126/science.1256328. Epub Aug. 7, 2014).

Jore, M., et al., "Structural basis for CRISPR RNA-guided DNA recognition by Cascade" Nature Structural & Molecular Biology 18:529-537 (2011).

Kim, Y.G., et al., "Site-specific cleavage of DNA-RNA hybrids by zinc finger/FokI cleavage domain fusions," Gene 203(1):43-49 (Dec. 5, 1997).

Klein, J., et al., "Design and characterization of structured protein linkers with differing flexibilities," Protein Engineering, Design & Selection 27(10):325-30 (Oct. 2014; doi:10.1093/protein/gzu043).

Kuznedelov K., et al., "Altered stoichiometry *Escherichia coli* Cascade complexes with shortened CRISPR RNA spacers are capable of interference and primed adaptation," Nucleic Acids Research 44(22):10849-10861 (2016; doi:10.1093/nar/gkw914).

Luo, M., et al., "The CRISPR RNA-guided surveillance complex in *Escherichia coli* accommodates extended RNA spacers," Nucleic Acids Research 44(15):7385-7394 (2016; doi:10.1093/nar/gkw421).

Makarova, K., et al., "Evolution and classification of the CRISPR-Cas systems," Nat. Rev. Microbiol. 9(6): 467-477 (Jun. 2011; doi:10.1038/nrmicro2577).

Makarova, K., et al., "SnapShot: Class 1 CRISPR-Cas Systems," Cell 168(5):946-946.e1 (Feb. 23, 2017; doi: 10.1016/j.cell.2017.02.018).

Mulepati, S., "Structural and Biochemical Analysis of Nuclease Domain of Clustered Regularly Interspaced Short Palindromic Repeat (CRISPR)-associated Protein 3 (Cas3)," Journal of Biological Chemistry 286(36):31896-31903 (2011; doi:10.1074/jbc.M111.270017).

Nishimasu, H., et al., "Structures and mechanisms of CRISPR RNA-guided effector nucleases," Current Opinion in Structural Biology 43:68-78 (Apr. 2017; doi:10.1016/j.sbi.2016.11.013. Epub Nov. 30, 2016).

Plagens, A., et al., "In vitro assembly and activity of an archaeal CRISPR-Cas type I-A Cascade interference complex," Nucleic Acids Research 42(8):5125-5138 (2014; doi:10.1093/nar/gku120).

Rath, D., et al., "The CRISPR-Cas immune system: biology, mechanisms and applications," Biochimie 117:119-28 (Oct. 2015; doi:10.1016/j.biochi.2015.03.025. Epub Apr. 10, 2015).

Redding, S., et al., "Surveillance and Processing of Foreign DNA by the *Escherichia coli* CRISPR-Cas System," Cell 163(4):854-865 (Nov. 5, 2015; doi: 10.1016/j.cell.2015.10.003).

Sashital, D., et al., "Mechanism of foreign DNA selection in a bacterial adaptive immune system," Mol. Cell. 46(5):606-15 (Jun. 8, 2012; doi: 10.1016/j.molcel.2012.03.020. Epub Apr. 19, 2012).

Sinkunas, T., et al., "Cas3 is a single-stranded DNA nuclease and ATP-dependent helicase in the CRISPR/Cas immune system," EMBO J. 30(7):1335-1342 (Apr. 6, 2011; doi: 10.1038/emboj.2011.41; Epub Feb. 22, 2011).

Sinkunas, T., et al., "In vitro reconstitution of Cascade-mediated CRISPR immunity in *Streptococcus thermophilus*," EMBO J. 32(3):385-394 (Feb. 6, 2013; doi:10.1038/emboj.2012.352; Epub Jan. 18, 2013).

Sorek, R., et al., "CRISPR-Mediated Adaptive Immune Systems in Bacteria and Archaea," Annu. Rev. Biochem. 82:237-266 (2013; doi: 10.1146/annurev-biochem-072911-172315, Epub Mar. 11, 2013).

Staals, R., et al., "Structure and activity of the RNA-targeting Type III-B CRISPR-Cas complex of Thermus thermophilus," Molecular cell 52(1):135-145 (2013; doi: 10.1016/j.molcel.2013.09.013).

Van der Oost, J., et al., "CRISPR-based adaptive and heritable immunity in prokaryotes," Trends in Biochemical Sciences 34(8):401-407 (2009; doi: 10.1016/tibs.2009.05.002; Jul. 29, 2009).

Venclovas, Č., et al., "Structure of Csm2 elucidates the relationship between small subunits of CRISPR-Cas effector complexes," FEBS Lett. 590(10):1521-9 (May 2016; doi: 10.1002/1873-3468.12179 Epub May 5, 2016).

Westra, E., et al., "CRISPR immunity relies on the consecutive binding and degradation of negatively supercoiled invader DNA by Cascade and Cas3," Molecular Cell 46(5):595-605 (2012; doi:10.1016/j.molcel.2012.03.018).

Wiedenheft, B., et al., "Structures of the RNA-guided surveillance complex from a bacterial immune system," Nature 477(7365):486-489 (Sep. 21, 2011; doi: 10.1038/nature10402).

(56) References Cited

OTHER PUBLICATIONS

Zhao, H., et al., "Increasing the homogeneity, stability and activity of human serum albumin and interferon-c2b fusion protein by linker engineering," Protein Expr. Purif. 61(1):73-7 (Sep. 2008; doi: 10.1016/j.pep.2008.04.013. Epub May 16, 2008).
Keskin, Ozlem, et al., "A new, structurally nonredundant, diverse data set of protein-protein interfaces and its implications," Protein Science, vol. 13, Apr. 2004, pp. 1043-1055.
Pakula, Andrew, A., et al., "Genetic Analysis of Protein Stability and Function," 1989; 23; pp. 289-310.
Singer, Maxine, et al., "Genes & Genomes, A Changing Perspective," University of Science Books, Mill Valley, California, 1998, pp. 63-64.
U.S. Appl. No. 14/997,474, filed Jan. 15, 2016, U.S. Pat. No. 9,885,026, Feb. 6, 2018, Granted.
U.S. Appl. No. 15/802,413, filed Nov. 2, 2017, U.S. Pat. No. 10,435,678, Oct. 8, 2019, Granted.
U.S. Appl. No. 16/554,225, filed Aug. 28, 2019, U.S. Pat. No. 10,711,257, Jul. 14, 2020, Granted.
U.S. Appl. No. 16/914,203, filed Jun. 26, 2020, Pending.
U.S. Appl. No. 16/104,875, filed Aug. 17, 2018, U.S. Pat. No. 10,227,576, Mar. 12, 2019, Granted.
U.S. Appl. No. 16/262,773, filed Jan. 30, 2019, U.S. Pat. No. 10,329,547, Jun. 25, 2019, Granted.
U.S. Appl. No. 16/420,061, filed May 22, 2019, U.S. Pat. No. 10,457,922, Oct. 29, 2019, Granted.
U.S. Appl. No. 16/665,316, filed Oct. 28, 2019, U.S. Pat. No. 10,597,648, Mar. 24, 2020, Granted.
U.S. Appl. No. 16/824,603, filed Mar. 19, 2020, U.S. Pat. No. 10,781,432, Sep. 22, 2020, Granted.
U.S. Appl. No. 17/027,257, filed Sep. 21, 2020, Pending.
Yanwu, Huo, et al.: "Structures of CRISPR Cas3 offer mechanistic insights into cascade-activated NDA unwinding and degradation," Nature Structural & Molecular Biology, vol. 21, No. 9, Aug. 24, 2014 (Aug. 24, 2014), pp. 771-777, XPO55664867, New York.
Kunne, Tim, et al.: "Cas3-Derived Target DNA Degradation Fragments Fuel Primed CRISPR Adaptation," Molecular Cell, Elsevier, Amsterdam, NL, vol. 63, No. 5, Aug. 18, 2016 (Aug. 18, 2016), 852-864, XP029711913.
Gong, Bei, et al.: "Molecular insights into DNA interference by CRISPR-associated nuclease-helicase Cas3," Proceedings of the National Academy of Sciences, vol. 111, No. 46, Nov. 3, 2014 (Nov. 3, 2014), pp. 16359-16364.
Hochstrasser, Megan, et al.: "DNATargeting by a Minimal CRISPR RNA-Guided Cascade," Molecular Cell, Elsevier, Amsterdam, NL, vol. 63, No. 5, Sep. 1, 2016 (Sep. 1, 2016), pp. 840-851.
Makarova, Kira, et al.: "Snapshot: Class 1 CRISPR-Cas Systems," Cell, Elsevier, Amsterdam, NL, vol. 168, No. 5, Feb. 27, 2017 (Feb. 27, 2017), p. 946.
Gleditzsch, D., et al. Modulating the Cascade architecture of a minimal Type 1-F CRISPR-Cas system. Nucleic Acids Research. Jul. 8, 2016, Epub May 23, 2016, vol. 44, No. 12; pp. 5872-5883.
Tsai, SQ et al., Dimeric CRISPR RNA-guided FokI nucleases for highly specific genome editing. Nature Biotechnology. Jun. 2014, Epub Apr. 25, 2014, vol. 32, No. 6; pp. 569-576.
Cameron, P., et al. Harnessing Type I CRISPR-Cas systems for genome engineering in human cells. Nature Biotechnology. Dec. 2019, Epub Nov. 18, 2019, vol. 37, No. 12, pp. 1471-1477.
Wu, Y., et al. Helicase-inactivating mutations as a basis for dominant negative phenotypes. Cell Cycle. Oct. 2010, vol. 15, No. 20, pp. 4080-4090.
Cas3 predicted helicase needed for Cascade anti-viral activity. NCBI reference sequence.
PCT Written Opinion of the International Searching Authority for related International Application No. PCT/US2019/036864.
PCT Search Report of the International Searching Authority for related International Application No. PCT/US2019/036864.
EP Supplementary Search Report of the International Searching Authority for related EP Application EP 19762697.
EP Written Opinion for related EP Application EP 19762697.
Wright, et al., "Biology and Applications of CRISPR Systems: Harnessing Nature's Toolbox for Genome Engineering," Cell, vol. 164, Jan. 14, 2016.

* cited by examiner

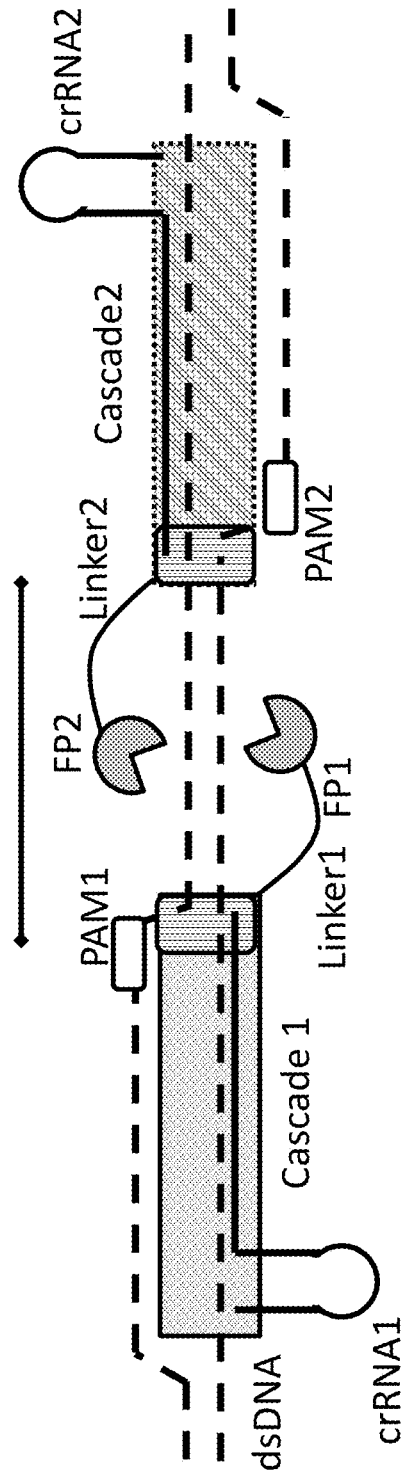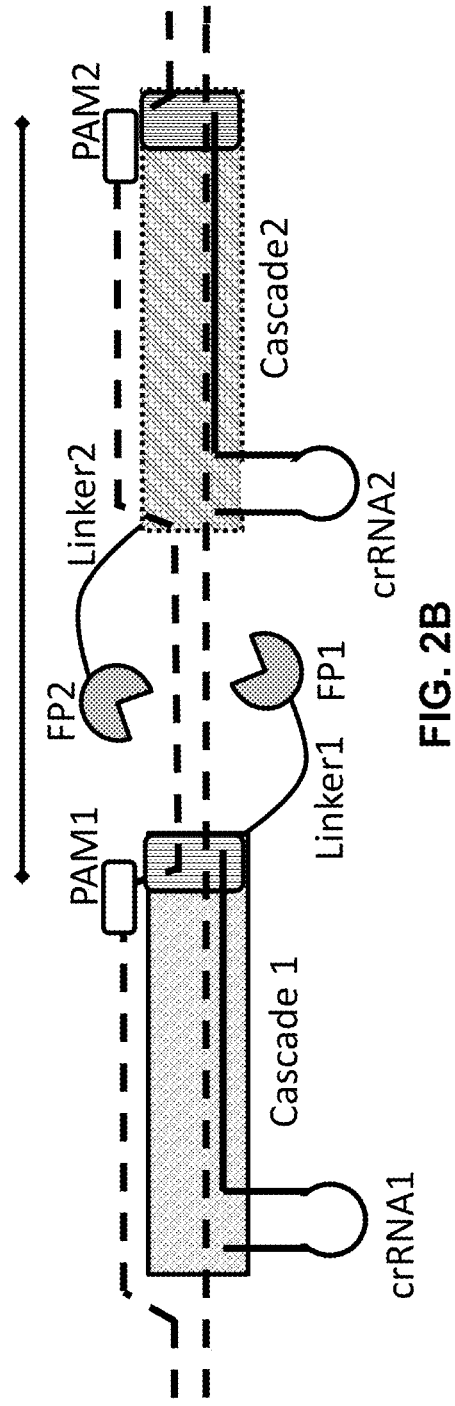
FIG. 2A
FIG. 2B

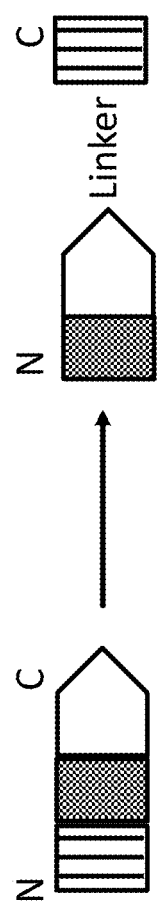
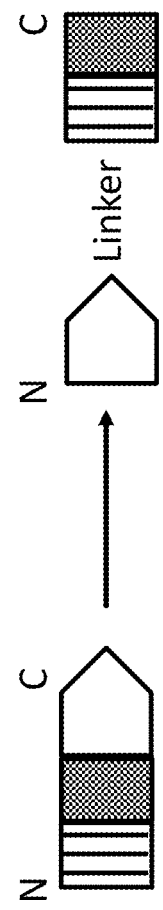
FIG. 3A
FIG. 3B

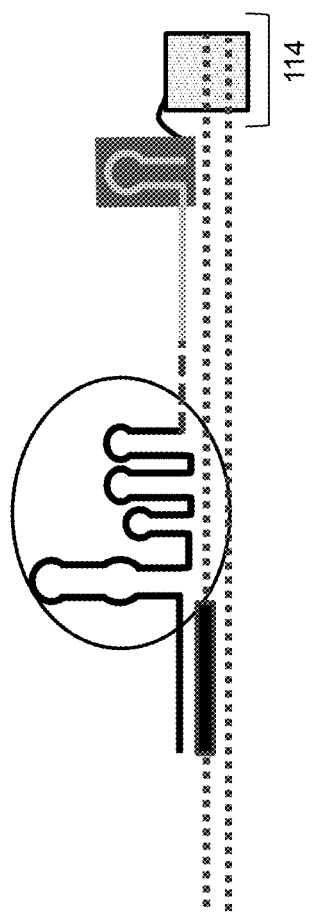

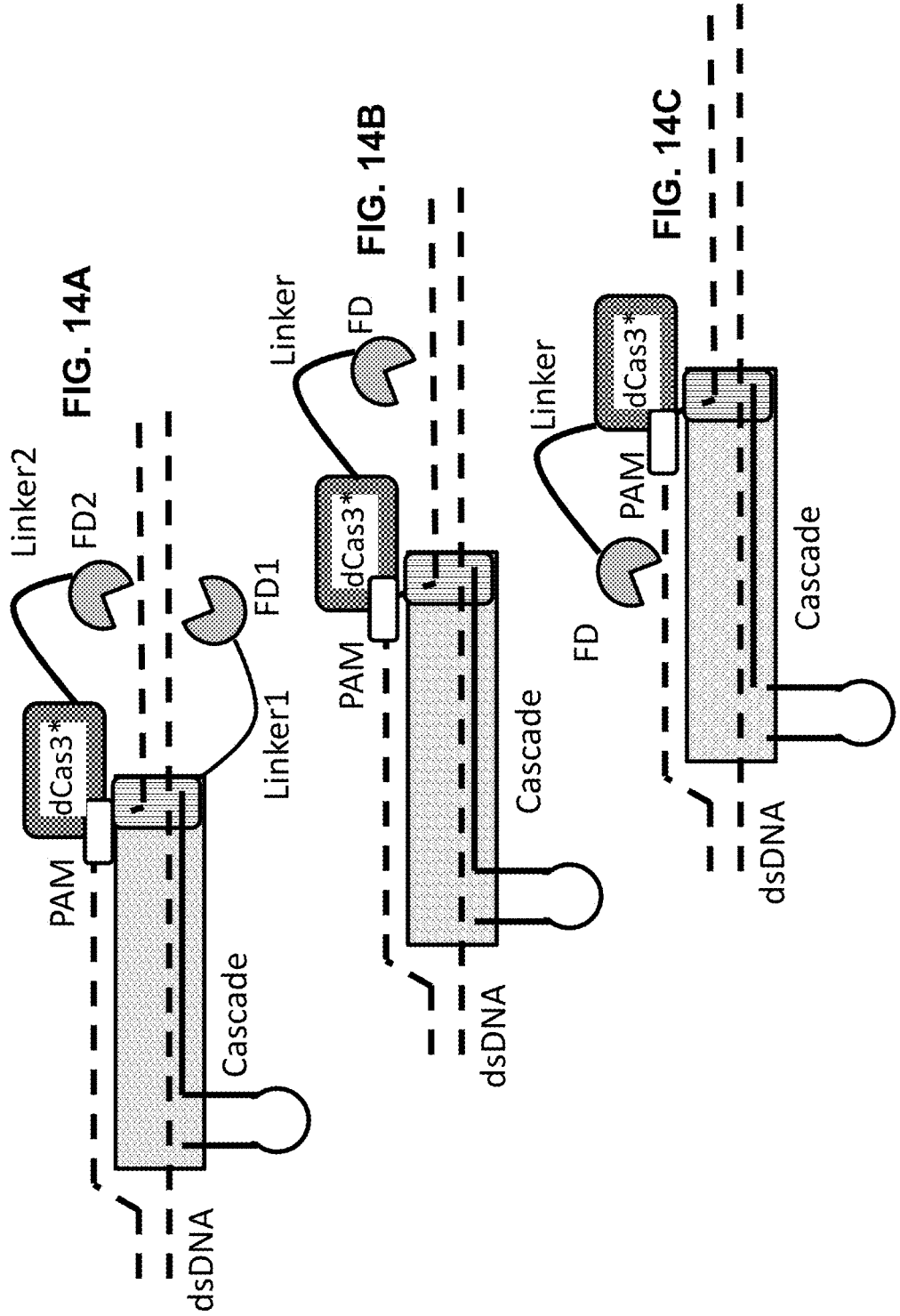

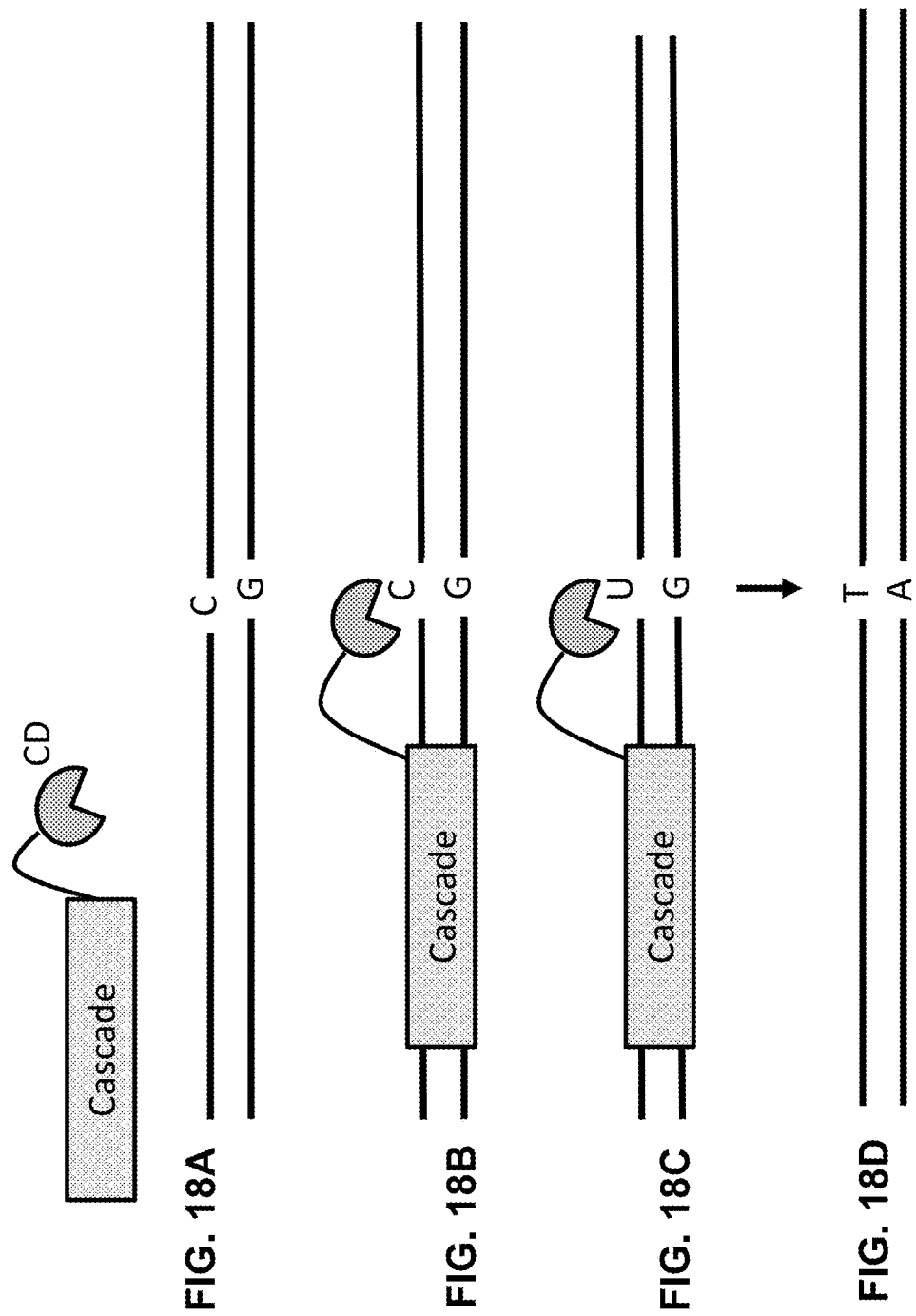

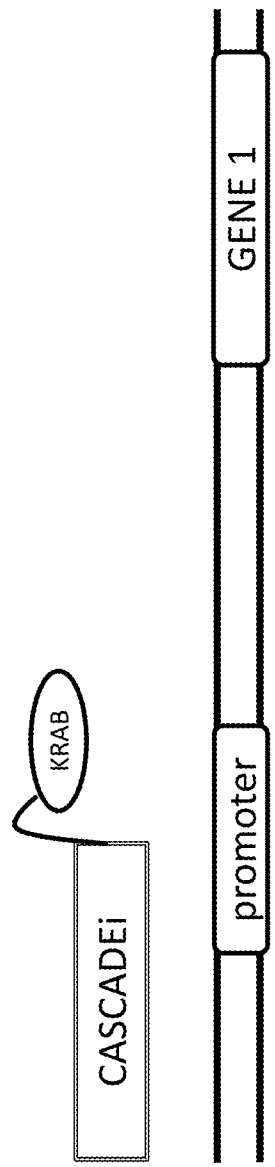
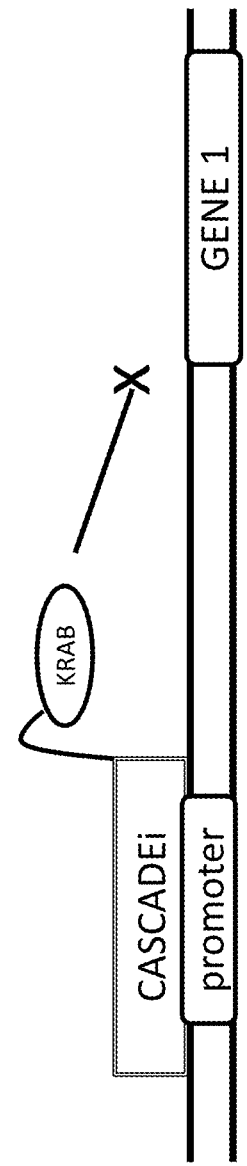
FIG. 20A
FIG. 20B

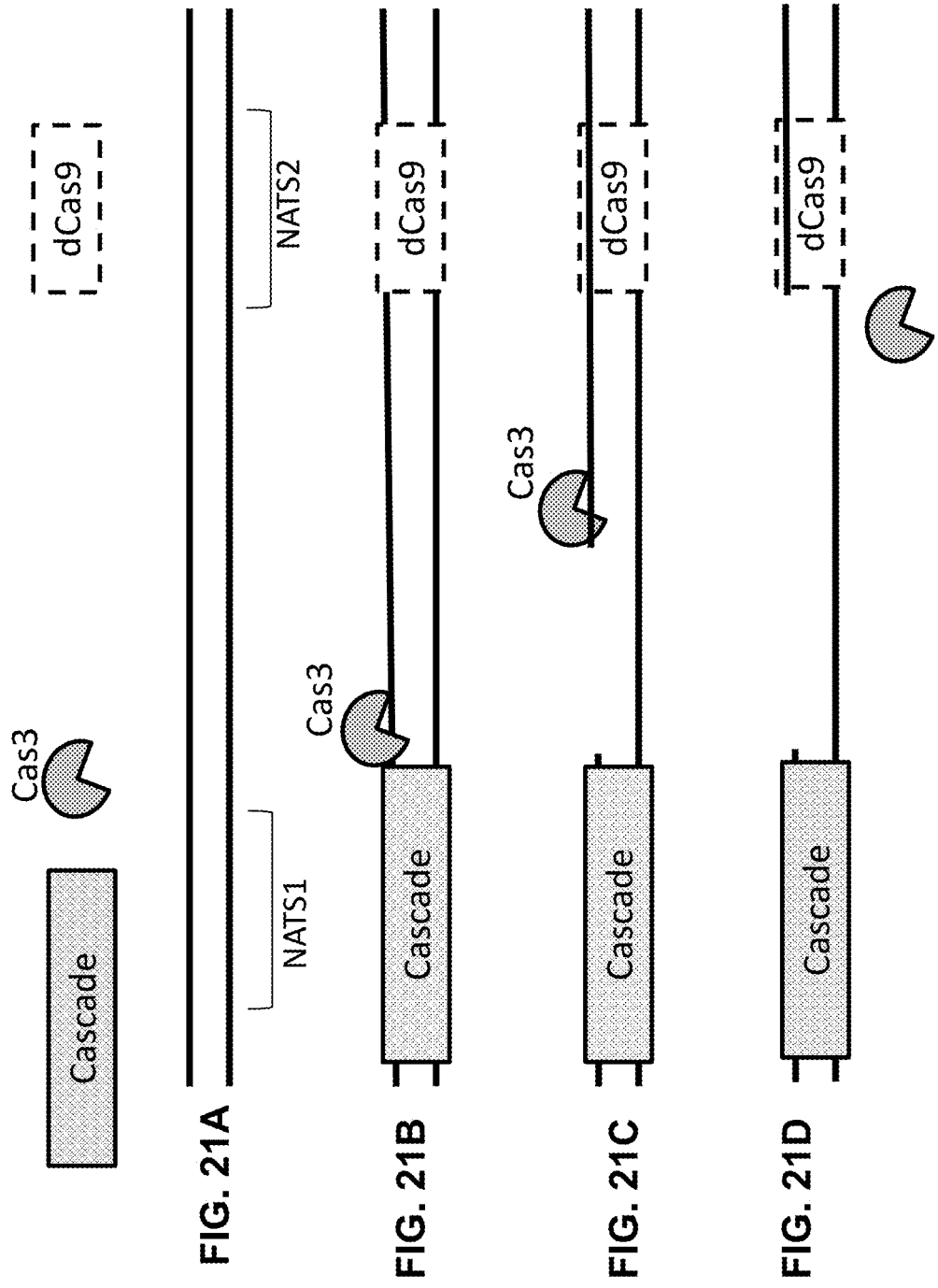

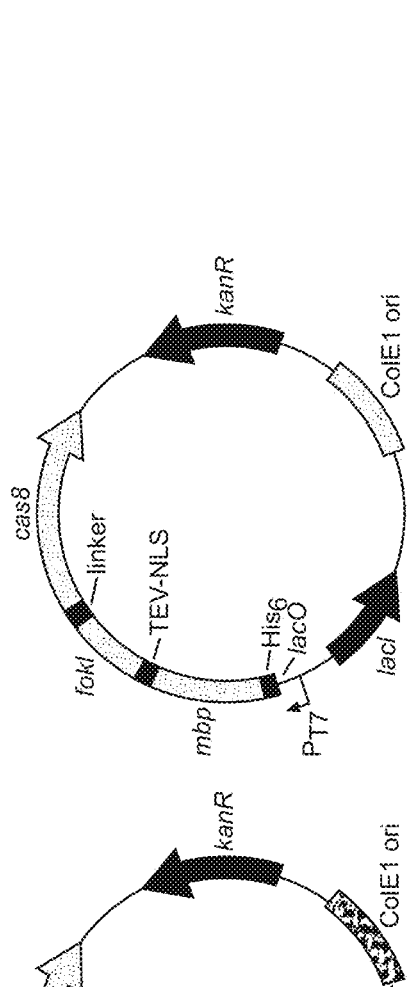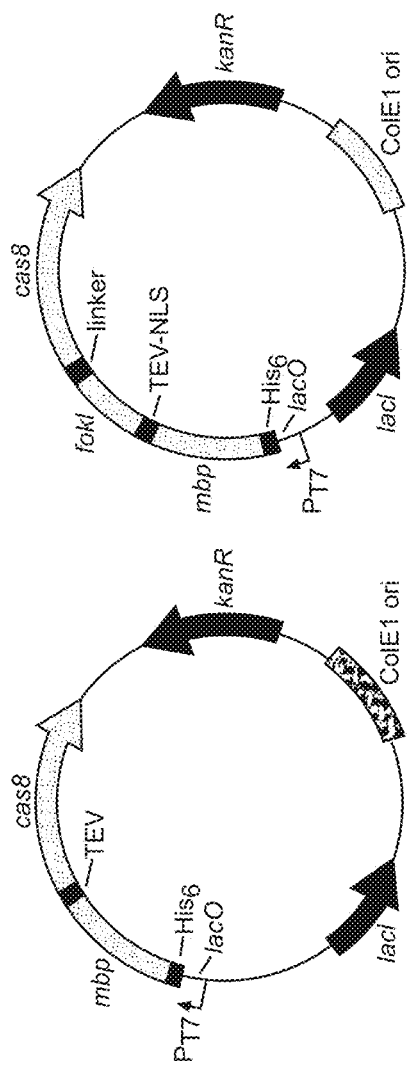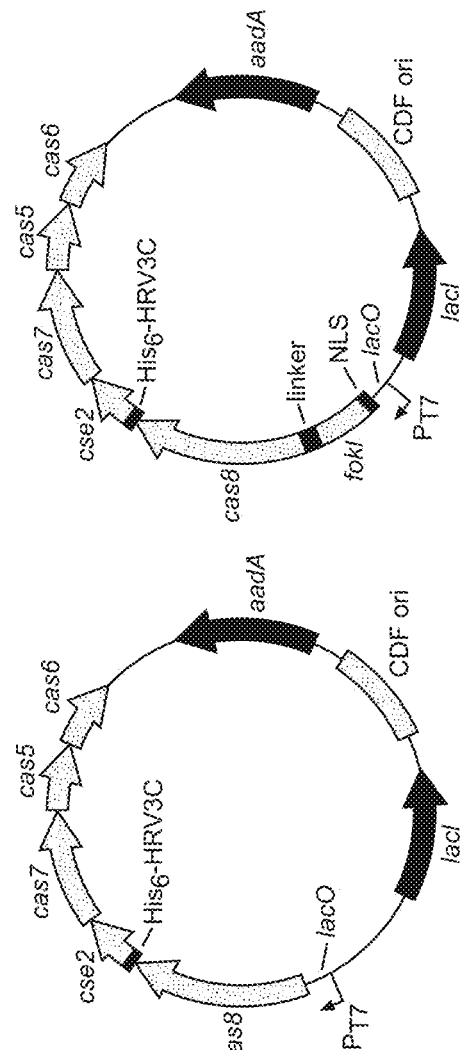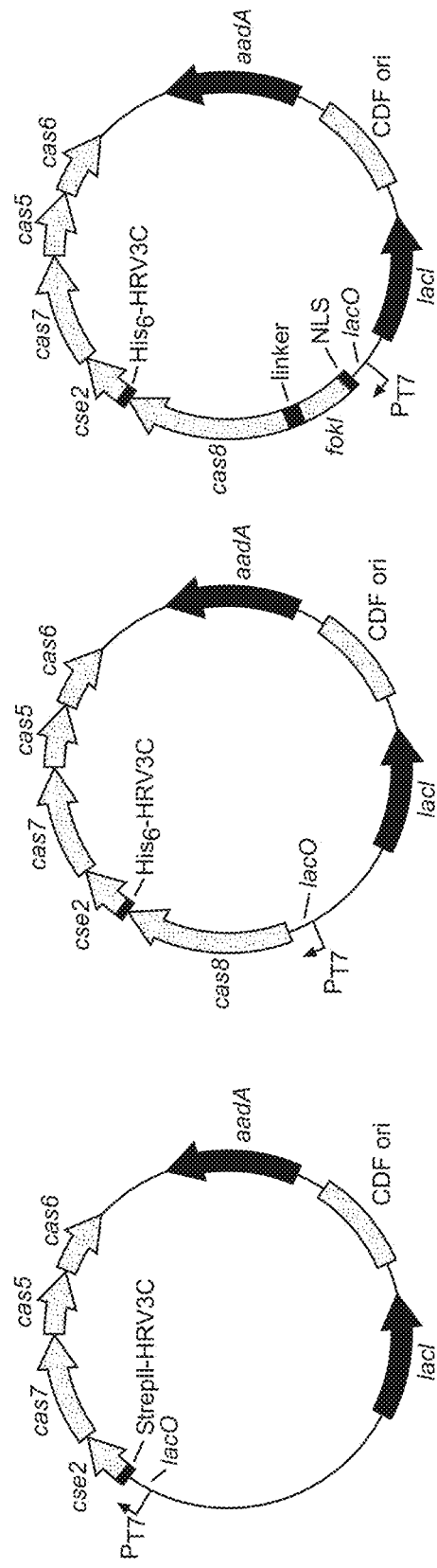
FIG. 23A FIG. 23B FIG. 23C FIG. 23D FIG. 23E

| | 5 | 10 | 15 | 17 | 20 | 30 | 40 | 50 |
|---|---|---|---|---|---|---|---|---|
| 14 | 0.07 | 0.03 | 0.03 | 0.04 | 0.06 | 0.03 | 0.04 | 0.04 |
| 16 | 0.11 | 0.02 | 0.05 | 0.09 | 0.04 | 0.04 | 0.07 | 0.04 |
| 18 | 0.04 | 0.02 | 0.04 | 0.05 | 0.02 | 0.07 | 0.01 | 0.03 |
| 20 | 0.01 | 0.00 | 0.04 | 0.14 | 0.04 | 0.11 | 0.02 | 0.06 |
| 22 | 0.04 | 0.03 | 0.17 | 1.03 | 0.09 | 0.05 | 0.06 | 0.05 |
| 24 | 0.03 | 0.03 | 0.10 | 0.36 | 0.14 | 0.10 | 0.08 | 0.06 |
| 26 | 0.12 | 0.04 | 0.09 | 0.24 | 0.06 | 0.02 | 0.08 | 0.06 |
| 28 | 0.13 | 0.01 | 0.17 | 0.14 | 0.21 | 0.12 | 0.01 | 0.16 |
| 30 | 0.10 | 0.10 | 0.24 | 1.38 | 0.83 | 0.54 | 0.71 | 0.35 |
| 32 | 0.10 | 1.14 | 2.17 | 5.67 | 5.11 | 2.39 | 2.04 | 1.26 |
| 34 | 0.06 | 0.09 | 0.24 | 1.70 | 1.02 | 0.62 | 0.60 | 0.38 |
| 36 | 0.04 | 0.04 | 0.05 | 0.16 | 0.21 | 0.25 | 0.55 | 0.48 |
| 38 | 0.02 | 0.00 | 0.02 | 0.02 | 0.00 | 0.01 | 0.00 | 0.01 |
| 40 | 0.77 | 0.08 | 0.26 | 0.80 | 0.12 | 0.24 | 0.33 | 0.18 |
| 42 | 0.04 | 0.04 | 0.12 | 1.08 | 0.43 | 0.38 | 0.73 | 0.40 |
| 44 | 0.02 | 0.01 | 0.03 | 0.08 | 0.08 | 0.12 | 0.16 | 0.19 |
| 46 | 0.01 | 0.02 | 0.01 | 0.98 | 0.02 | 0.03 | 0.01 | 0.02 |
| 48 | 0.08 | 0.06 | 0.07 | 0.08 | 0.05 | 0.05 | 0.07 | 0.08 |
| 50 | 0.04 | 0.02 | 0.05 | 0.03 | 0.05 | 0.07 | 0.05 | 0.09 |
| 52 | 0.05 | 0.10 | 0.01 | 0.10 | 0.08 | 0.12 | 0.09 | 0.13 |
| 54 | 0.04 | 0.05 | 0.14 | 0.06 | 0.03 | 0.04 | 0.05 | 0.02 |
| 56 | 0.18 | 0.03 | 0.05 | 0.09 | 0.01 | 0.02 | 0.00 | 0.05 |
| 58 | 0.09 | 0.09 | 0.07 | 0.11 | 0.16 | 0.13 | 0.11 | 0.26 |
| 60 | 0.02 | 0.02 | 0.07 | 0.07 | 0.13 | 0.01 | 0.01 | 0.11 |

FIG. 31B

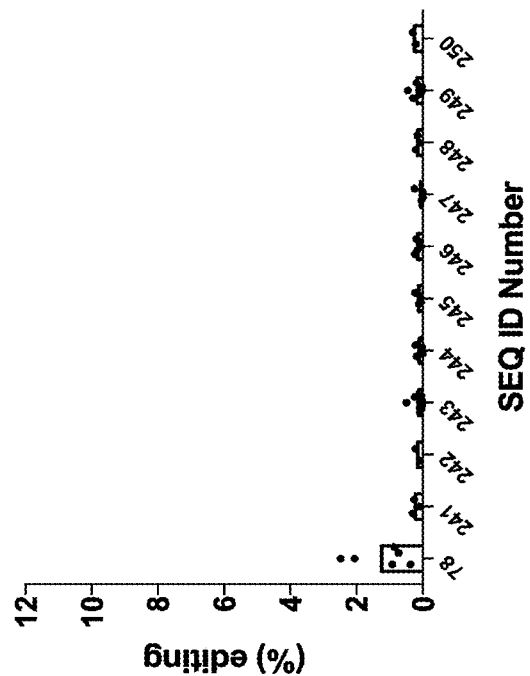
FIG. 33A
FIG. 33B

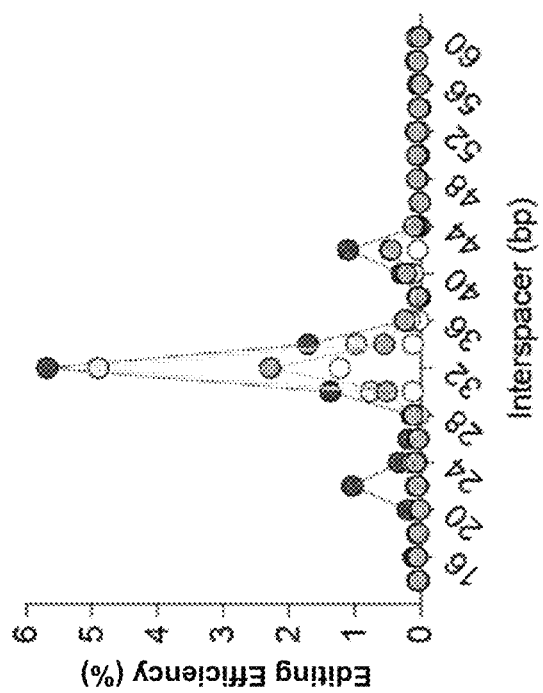
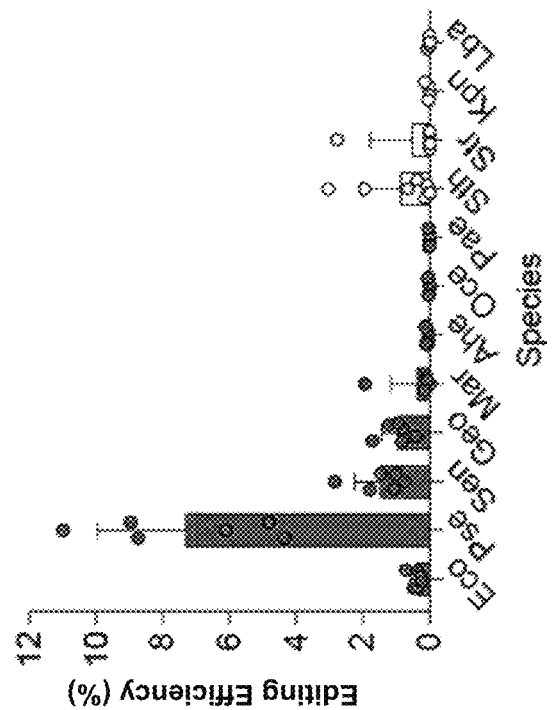
FIG. 37A
FIG. 37B

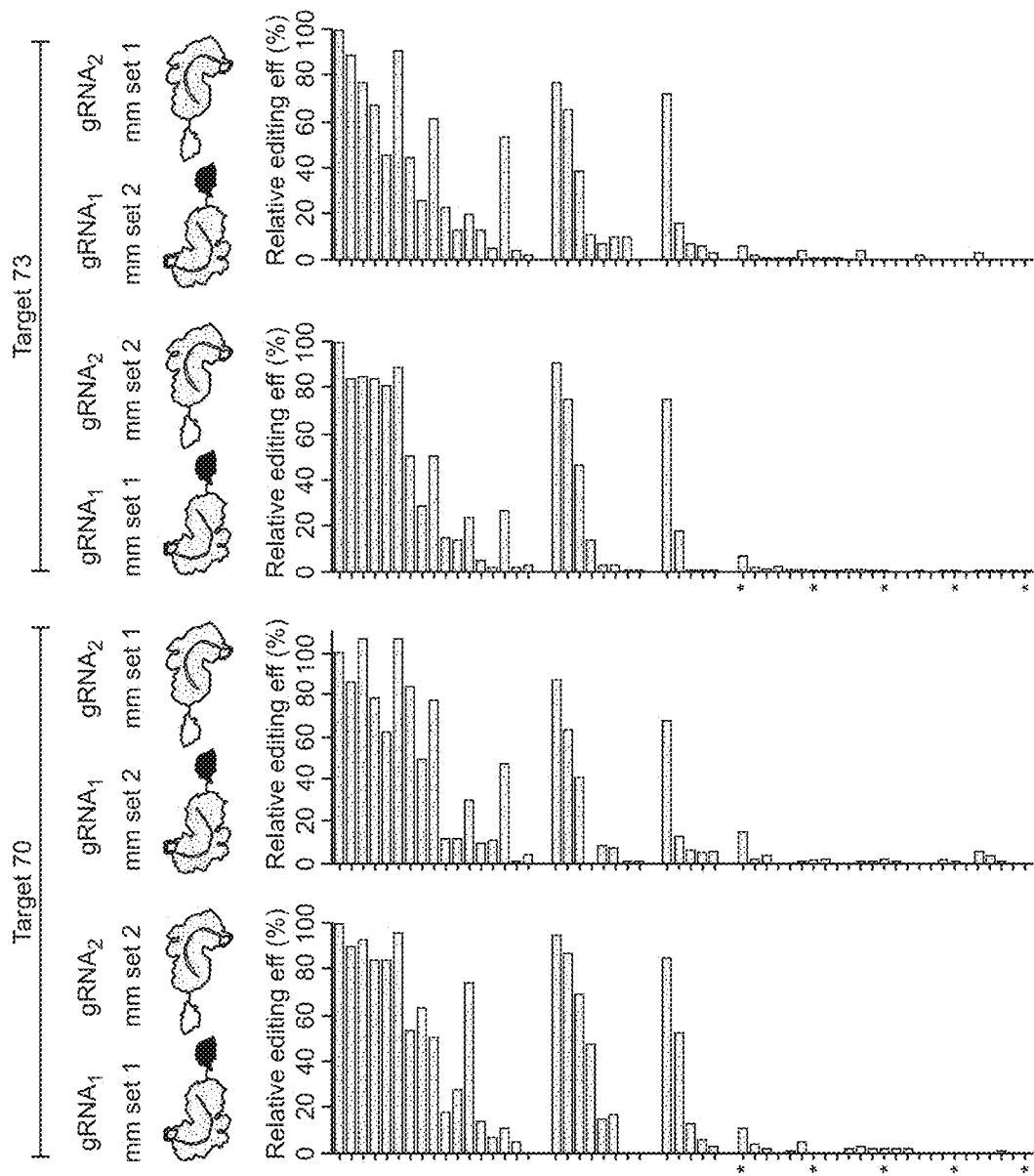

ENGINEERED CASCADE COMPONENTS AND CASCADE COMPLEXES

CROSS-REFERENCE TO RELATED APPLICATIONS

This application is a bypass continuation of PCT/US2019/036864 filed 12 Jun. 2019, now pending, which claims the benefit of U.S. patent application Ser. No. 16/420,061, filed 22 May 2019, now U.S. Pat. No. 10,457,922, issued 29 Oct. 2019, which is a continuation of U.S. patent application Ser. No. 16/262,773, filed 30 January 2019, now U.S. Pat. No. 10,329,547, issued 25 Jun. 2019, which is a continuation of U.S. patent application Ser. No. 16/104,875, filed 17 Aug. 2018, now U.S. Pat. No. 10,227,576, issued 12 Mar. 2019; and which claims the benefit of U.S. Provisional Patent Application Ser. No. 62/684,735, filed 13 Jun. 2018, and U.S. Provisional Patent Application Ser. No. 62/807,717, filed 19 Feb. 2019; the contents of which are herein incorporated by reference in their entireties.

STATEMENT REGARDING FEDERALLY SPONSORED RESEARCH OR DEVELOPMENT

Not applicable.

SEQUENCE LISTING

The present application contains a Sequence Listing that has been submitted electronically in ASCII format and is hereby incorporated by reference in its entirety. The ASCII copy, created on 8 Dec. 2020 is named CBI032-16_ST25.txt and is 3.1 MB in size.

TECHNICAL FIELD

The present disclosure relates generally to engineered Class 1 Type I CRISPR-Cas (Cascade) systems that comprise multi-protein effector complexes, nucleoprotein complexes comprising Type I CRISPR-Cas subunit proteins and nucleic acid guides, polynucleotides encoding Type I CRISPR-Cas subunit proteins, and guide polynucleotides. The disclosure also relates to compositions and methods for making and using the engineered Type I CRISPR-Cas systems of the present invention.

BACKGROUND

Clustered regularly interspaced short palindromic repeats (CRISPR) and CRISPR-associated proteins (Cas) constitute CRISPR-Cas systems. The CRISPR-Cas systems provide adaptive immunity against foreign polynucleotides in bacteria and archaea (see, e.g., Barrangou, R., et al., Science 315:1709-1712 (2007); Makarova, K. S., et al., Nature Reviews Microbiology 9:467-477 (2011); Garneau, J. E., et al., Nature 468:67-71 (2010); Sapranauskas, R., et al., Nucleic Acids Res. 39:9275-9282 (2011); Koonin, E. V., et al., Curr. Opin. Microbiol. 37:67-78 (2017)). Various CRISPR-Cas systems in their native hosts are capable of DNA targeting (Class 1 Type I; Class 2 Type II and Type V), RNA targeting (Class 2 Type VI), and joint DNA and RNA targeting (Class 1 Type III) (see, e.g., Makarova, K. S., et al., Nat. Rev. Microbiol. 13:722-736 (2015); Shmakov, S., et al., Nat. Rev. Microbiol. 15:169-182 (2017); Abudayyeh, O. O., et al., Science 353:1-17 (2016)).

The classification of CRISPR-Cas systems has had many iterations. Koonin, E. V., et al., (Curr. Opin. Microbiol. 37:67-78 (2017)) proposed a classification system that takes into consideration the signature cas genes specific for individual types and subtypes of CRISPR-Cas systems. The classification also considered sequence similarity between multiple shared Cas proteins, the phylogeny of the best conserved Cas protein, gene organization, and the structure of the CRISPR array. This approach provided a classification scheme that divides CRISPR-Cas systems into two distinct classes: Class 1 comprising a multiprotein effector complex (Type I (CRISPR-associated complex for antiviral defense ("Cascade") effector complex), Type III (Cmr/Csm effector complex), and Type IV); and Class 2 comprising a single effector protein (Type II (Cas9), Type V (Cas12a, previously referred to as Cpf1), and Type VI (Cas13a, previously referred to as C2c2)). In the Class 1 systems, Type I is the most common and diverse, Type III is more common in archaea than bacteria, and Type IV is least common.

The Type I systems comprise the signature Cas3 protein. The Cas3 protein has helicase and DNase domains responsible for DNA target sequence cleavage. To date, seven subtypes of the Type I system have been identified (i.e., Type I-A, I-B, I-C, I-D, I-E, I-F (and variants for I-F (e.g., I-Fv1, I-Fv2)), and I-U) that have a variable number of cas genes. Type I cas genes include, but are not limited to, the following: cas7, cas5, cas8, cse2, csa5, cas3, cas2, cas4, cas1, and cas6. Examples of organisms having Type I systems are as follows: I-A, *Archaeoglobus fulgidus*; I-B, *Clostridium kluyveri*; I-C, *Bacillus halodurans*; I-U, *Geobacter sulfurreducens*; I-D, *Cyanothece* sp. 8802; I-E, *Escherichia coli* K12 (*E. coli* K12); I-F, *Yersinia pseudo-tuberculosis*; I-F variant, *Shewanella putrefaciens* CN-32 (Koonin, E. V., et al., Curr. Opin. Microbiol. 37:67-78 (2017)). Characteristics of Cas3 protein mediated cleavage and progressive degradation of DNA have been described (see, e.g., Plagens, A., et al., Nucleic Acids Res. 42:5125-5138 (2014); Maier, L., et al., RNA Biol. 10:865-874 (2013); Hochstrasser, M., et al., Proc. Natl. Acad. Sci. USA 111:6618-6623 (2014); Sinkunas, T., et al., EMBO J. 30:1335-1342 (2011); Westra, E., et al., Mol. Cell 46:595-605 (2012); Mulepati, S., et al., J. Biol. Chem. 288:22184-22192 (2013); Sinkunas, T., et al., EMBO J. 32:385-394 (2013); Mulepati, S., et al., J. Biol. Chem. 288:22184-22192 (2013); Redding, S., et al., Cell 163:854-865 (2015); Sinkunas, T., et al., EMBO J. 32:385-394 (2013); Westra, E., et al., Mol. Cell 46:595-605 (2012)).

Type I systems typically encode proteins that combine with a CRISPR RNA (crRNA or "guide RNA") to form a Cascade complex. These complexes comprise multiple proteins and a crRNA, both of which are transcribed from this CRISPR locus. In Type I systems, primary processing of a pre-crRNA is catalyzed by Cas6. This typically results in a crRNA with a 5' handle of 8 nucleotides, a spacer region, and a 3' handle; both the 5' and the 3' handles are derived from the repeat sequence. In some systems, the 3' handle forms a stem-loop structure; in other systems, secondary processing of the 3' end of crRNA is catalyzed by ribonuclease(s) (see, e.g., van der Oost, J., et al., Nature Reviews Microbiology 12:479-492 (2014)).

The Cascade effector complexes of the Type I CRISPR-Cas systems comprise a backbone having paralogous Repeat-Associated Mysterious Proteins (RAMPs; e.g., Cas7 and Cas5 proteins) containing the RNA Recognition Motif (RRM) fold and additional "large" and "small" subunit proteins (see, e.g., Koonin, E. V., et al., Curr. Opin. Microbiol. 37:67-78, (2017), FIG. 2). These Cascade effector complexes typically have a Cas5 subunit protein and several Cas7 subunit proteins. Such Cascade effector complexes also comprise the guide RNA. The Cascade effector complexes comprise the various subunit proteins arranged in an asymmetric fashion along the length of the guide RNA. The Cas5 subunit protein and the large subunit protein (Cas8 protein) are positioned at one end of the complex, enveloping the 5' end of the guide RNA. Several copies of the small subunit protein interact with the guide RNA backbone, which is bound to multiple copies of the Cas7 subunit protein. The Cas6 subunit protein, another RAMP protein, is associated with the Cascade effector complex primarily through association with the 3' handle (repeat region) of the crRNA. The Cas6 subunit protein usually functions as the repeat-specific RNase involved in pre-crRNA processing; however, in Type I-C systems, Cas5 functions as the repeat-specific RNase and there is no Cas6.

The primary sequences of the CRISPR-Cas Type I Cascade subunit proteins have little sequence identity; however, the presence of homologous RAMP modules and the overall structural similarity of the multiprotein effector complexes supports a common origin of these effector complexes (see, e.g., Koonin, E. V., et al., Curr. Opin. Microbiol. 37:67-78 (2017)).

The adaptive immunity mechanism of action in the Type I CRISPR-Cas systems involves essentially three phases: adaptation, expression, and interference. In the adaptation phase, a foreign DNA or RNA infects the host and proteins encoded by various cas genes bind regions of the infecting DNA or RNA. Such regions are called protospacers. A protospacer adjacent motif (PAM) is a short nucleotide sequence (e.g., 2 to 6 base pair DNA sequence) that is adjacent to the protospacer. PAM sequences are typically recognized by a Cas1 subunit protein/Cas2 subunit protein complex, wherein the active PAM-sensing site is associated with the Cas1 subunit proteins (see, e.g., Jackson, S. A., et al., Science 356:356(6333) (2017)).

In the expression phase, the CRISPR array comprising multiple spacer-repeat elements is transcribed as a single transcript. Individual spacer repeat elements are processed by an endonuclease (e.g., Type I, a Cas6 protein; and Type I-C, a Cas5 protein) into individual crRNAs. Cas subunit proteins are expressed and associate with the crRNA to form a Cascade effector complex.

The Cascade effector complex scans foreign polynucleotides infecting the host to identify DNA complementary to the spacer. In Type I systems, interference occurs when the effector complex identifies a sequence complementary to the spacer that is adjacent to a PAM; and the Cas3 protein is recruited to the DNA-bound Cascade effector complex to cleave and progressively digest the foreign polynucleotide.

Makarova, K. S., et al., (Cell 168:946 (2017)) provide a summary of genes, homologs, Cascade complexes, and mechanisms of action for Type I CRISPR-Cas systems.

Type I CRISPR-Cas systems have thus far had limited use in eukaryotic genome engineering applications, due in part to the difficulty of heterologous expression of the Cascade complex and the way in which the Type I CRISPR-Cas systems cleave DNA targets.

SUMMARY OF THE INVENTION

The present invention generally relates to compositions comprising engineered Type I CRISPR-Cas effector complexes and components thereof, including protein components, modified or distinctly changed guide polynucleotides, and combinations thereof.

One embodiment of the present invention is a composition comprising:
- a first engineered Type I CRISPR-Cas effector complex comprising,
- a first Cse2 subunit protein, a first Cas5 subunit protein, a first Cas6 subunit protein, and a first Cas7 subunit protein,
- a first fusion protein comprising a first Cas8 subunit protein and a first FokI, wherein the N-terminus of the first Cas8 subunit protein or the C-terminus of the first Cas8 subunit protein is covalently connected by a first linker polypeptide to the C-terminus or N-terminus, respectively, of the first FokI, and wherein the first linker polypeptide has a length of between 10 amino acids and 40 amino acids, and
- a first guide polynucleotide comprising a first spacer capable of binding a first nucleic acid target sequence; and
- a second engineered Type I CRISPR-Cas effector complex comprising,
- a second Cse2 subunit protein, a second Cas5 subunit protein, a second Cas6 subunit protein, and a second Cas7 subunit protein,
- a second fusion protein comprising a second Cas8 subunit protein and a second FokI, wherein the N-terminus of the second Cas8 subunit protein or the C-terminus of the second Cas8 protein is covalently connected by a second linker polypeptide to the C-terminus or N-terminus, respectively, of the second FokI, and wherein the second linker polypeptide has a length of between 10 amino acids and 40 amino acids, and
- a second guide polynucleotide comprising a second spacer capable of binding a second nucleic acid target sequence, wherein a protospacer adjacent motif (PAM) of the second nucleic acid target sequence and a PAM of the first nucleic acid target sequence have an interspacer distance between 20 base pairs and 42 base pairs.

In some embodiments, the length of the first linker polypeptide and/or the second linker polypeptide is a length of between 15 amino acids and 30 amino acids, or between 17 amino acids and 20 amino acids. In one embodiment, the length of the first linker polypeptide and the second linker polypeptide are the same.

Interspacer distances between the second nucleic acid target sequence and the first nucleic acid target sequence include, but are not limited to, between 22 base pairs and 40 base pairs, between 26 base pairs and 36 base pairs, between 29 base pairs and 35 base pairs, or between 30 base pairs and 34 base pairs.

The first FokI and the second FokI can be monomeric subunits that are capable of associating to form a homodimer, or distinct subunits that are capable of associating to form a heterodimer.

In some embodiments, the N-terminus of the first Cas8 subunit protein is covalently connected by the first linker polypeptide to the C-terminus of the first FokI, the C-terminus of the first Cas8 subunit protein is covalently connected by a first linker polypeptide to the N-terminus of the first FokI, the N-terminus of the second Cas8 subunit protein is covalently connected by the second linker polypeptide to the C-terminus of the second FokI, the C-terminus of the second Cas8 subunit protein is covalently connected by a second linker polypeptide to the N-terminus of the second FokI, and combinations thereof. The first Cas8 subunit protein and the second Cas8 subunit protein can each comprise a Cas8 subunit protein having a different sequence or both the first and the second Cas8 subunit protein can comprise identical amino acid sequences.

Similarly, the first Cse2 subunit protein and the second Cse2 subunit protein can each comprise different or identical Cse2 subunit protein amino acid sequences, the first Cas5 subunit protein and the second Cas5 subunit protein can each comprise different or identical Cas5 subunit protein amino acid sequences, the first Cas6 subunit protein and the second Cas6 subunit protein can each comprise different or identical Cas6 subunit protein amino acid sequences, the first Cas7 subunit protein and the second Cas7 subunit protein can each comprise different or identical Cas7 subunit protein amino acid sequences, and combinations thereof.

In a preferred embodiment, the guide polynucleotides comprise RNA.

In an additional embodiment, the present invention includes an engineered Type I CRISPR Cas3 mutant protein ("mCas3 protein") capable of reduced movement along DNA relative to a wild-type Type I CRISPR Cas3 protein ("wtCas3 protein").

The present invention also includes the use of the above compositions to perform genome editing in cells, as well as methods of make the above compositions.

Further embodiments of the present invention will be readily apparent to those of ordinary skill in the art in view of the disclosures herein.

BRIEF DESCRIPTION OF THE FIGURES

The Figures are not proportionally rendered, nor are they to scale. The locations of indicators are approximate.

FIG. 2A, FIG. 2B, and FIG. 2C present illustrative examples of two engineered Type I CRISPR-Cas effector complexes with fusion domains bound to neighboring spacer sequences.

FIG. 3A and FIG. 3B present examples of circularly permuted proteins.

FIG. 12A, FIG. 12B, and FIG. 12C present a generalized illustration of site-directed recruitment of a functional protein domain fused to a Cascade subunit protein by a dCas9: NATNA complex.

FIG. 13A, FIG. 13B, FIG. 14A, FIG. 14B, and FIG. 14C illustrate examples of engineered Type I CRISPR-Cas effector complexes of the present invention.

FIG. 15A, FIG. 15B, FIG. 15C, FIG. 16A, FIG. 16B, FIG. 16C, FIG. 17A, FIG. 17B, FIG. 17C, FIG. 18A, FIG. 18B, FIG. 18C, FIG. 18D, FIG. 19A, FIG. 19B, FIG. 20A, and FIG. 20B present examples of engineered Type I CRISPR-Cas effector complexes of the present invention and methods of use thereof.

FIG. 21A, FIG. 21B, FIG. 21C, FIG. 21D, FIG. 22A, FIG. 22B, FIG. 22C, and FIG. 22D illustrate embodiments of the present invention that use a Cas3 protein comprising active endonuclease activity.

FIG. 23A, FIG. 23B, FIG. 23C, FIG. 23D, FIG. 23E, FIG. 24, FIG. 25, FIG. 26, and FIG. 27 present schematic diagrams of a variety of Cascade component expression systems.

FIG. 28, FIG. 29, FIG. 30, FIG. 31A, FIG. 31B, FIG. 32, FIG. 33A, FIG. 33B, and FIG. 34 present data related to genome editing of the engineered Cascade systems of the present invention.

FIG. 37A, FIG. 37B, FIG. 37C, FIG. 37D, FIG. 37E, FIG. 37F, and FIG. 37G present data related to repair outcomes.

FIG. 38A, FIG. 38B, and FIG. 38C present data related to how mismatches between gRNAs and target DNA inhibit genome editing by engineered Type I CRISPR-Cas complexes.

INCORPORATION BY REFERENCE

Figure 1A:
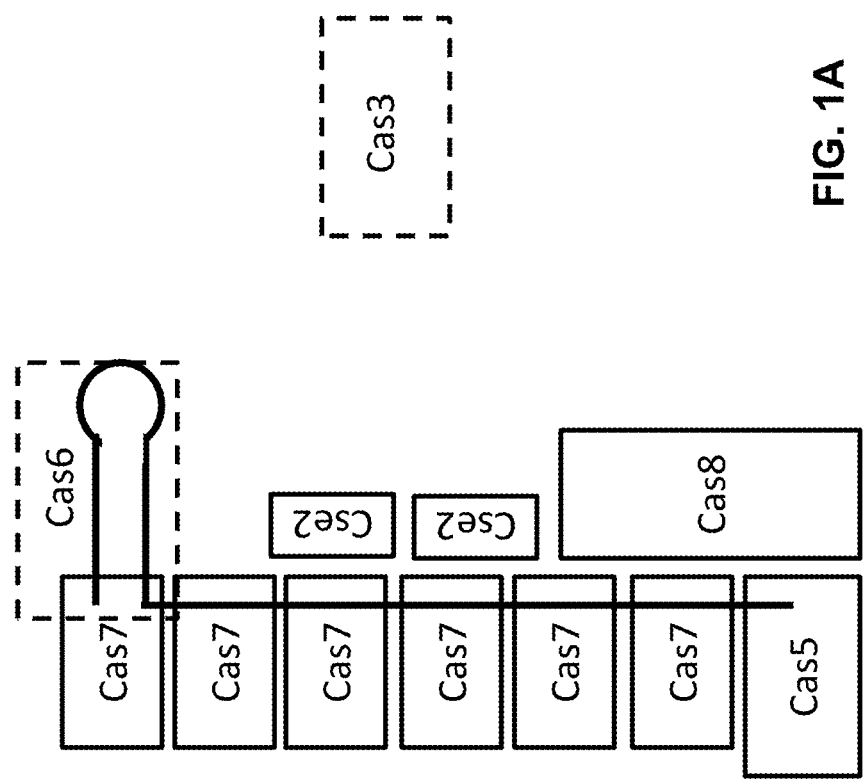
FIG. 1A present a generalized illustration of a Type I CRISPR-Cas effector complex.

All patents, publications, and patent applications cited in the present Specification are herein incorporated by reference as if each individual patent, publication, or patent application was specifically and individually indicated to be incorporated by reference in its entirety for all purposes.

DETAILED DESCRIPTION OF THE INVENTION

It is to be understood that the terminology used herein is for the purpose of describing particular embodiments only, and is not intended to be limiting. As used in the present Specification and the Claims, the singular forms "a," "an," and "the" include plural referents unless the context clearly dictates otherwise. Thus, for example, reference to "a polynucleotide" includes one or more polynucleotides, and reference to "a vector" includes one or more vectors.

Unless defined otherwise, all technical and scientific terms used herein have the same meaning as commonly understood by one of ordinary skill in the art to which the invention pertains. Although other methods and materials similar, or equivalent, to those described herein can be useful in the present invention, preferred materials and methods are described herein.

In view of the teachings of the present Specification and the Examples, one of ordinary skill in the art can apply conventional techniques of immunology, biochemistry, chemistry, molecular biology, microbiology, cell biology, genomics, and recombinant polynucleotides, as taught, for example, by the following standard texts: Cellular and Molecular Immunology, Ninth Edition, A. K. Abbas., et al., Elsevier (2017), ISBN 978-0323479783; Cancer Immunotherapy Principles and Practice, First Edition, L. H. Butterfield, et al., Demos Medical (2017), ISBN 978-1620700976; Janeway's Immunobiology, Ninth Edition, Kenneth Murphy, Garland Science (2016), ISBN 978-0815345053; Clinical Immunology and Serology: A Laboratory Perspective, Fourth Edition, C. Dorresteyn Stevens, et al., F.A. Davis Company (2016), ISBN 978-0803644663; Antibodies: A Laboratory Manual, Second edition, E. A. Greenfield, Cold Spring Harbor Laboratory Press (2014), ISBN 978-1-936113-81-1; Culture of Animal Cells: A Manual of Basic Technique and Specialized Applications, Seventh Edition, R. I. Freshney, Wiley-Blackwell (2016), ISBN 978-1118873656; Transgenic Animal Technology, Third Edition: A Laboratory Handbook, C. A. Pinkert, Elsevier (2014), ISBN 978-0124104907; The Laboratory Mouse, Second Edition, H. Hedrich, Academic Press (2012), ISBN 978-0123820082; Manipulating the Mouse Embryo: A Laboratory Manual, Fourth Edition, R. Behringer, et al., Cold Spring Harbor Laboratory Press (2013), ISBN 978-1936113019; PCR 2: A Practical Approach, M. J. McPherson, et al., IRL Press (1995), ISBN 978-0199634248; Methods in Molecular Biology (Series), J. M. Walker, ISSN 1064-3745, Humana Press; RNA: A Laboratory Manual, D. C. Rio, et al., Cold Spring Harbor Laboratory Press (2010), ISBN 978-0879698911; Methods in Enzymology (Series), Academic Press; Molecular Cloning: A Laboratory Manual (Fourth Edition), M. R. Green, et al., Cold Spring Harbor Laboratory Press (2012), ISBN 978-1605500560; Bioconjugate Techniques, Third Edition, G. T. Hermanson, Academic Press (2013), ISBN 978-0123822390; Methods in Plant Biochemistry and Molecular Biology, W. V. Dashek, CRC Press (1997), ISBN 978-0849394805; Plant Cell Culture Protocols (Methods in Molecular Biology), V. M. Loyola-Vargas, et al., Humana Press (2012), ISBN 978-1617798177; Plant Transformation Technologies, C. N. Stewart, et al., Wiley-Blackwell (2011), ISBN 978-0813821955; Recombinant Proteins from Plants (Methods in Biotechnology), C. Cunningham, et al., Humana Press (2010), ISBN 978-1617370212; Plant Genomics: Methods and Protocols (Methods in Molecular Biology), W. Busch, Humana Press (2017), ISBN 978-1493970018; Plant Biotechnology: Methods in Tissue Culture and Gene Transfer, R. Keshavachandran, et al., Orient Blackswan (2008), ISBN 978-8173716164.

Clustered regularly interspaced short palindromic repeats (CRISPR) and related CRISPR-associated proteins (Cas proteins) constitute CRISPR-Cas systems (see, e.g., Barrangou, R., et al., Science 315:1709-1712 (2007)).

As used herein, "Cas protein," "CRISPR-Cas protein," and "CRISPR-Cas subunit protein," and "Cas subunit protein," unless otherwise identified, all refer to Class 1 Type I CRISPR-Cas proteins. Typically, for use in aspects of the present invention, Cas subunit proteins are capable of interacting with one or more cognate polynucleotides (most typically, a crRNA) to form a Type I effector complex (most typically, an RNP complex).

The genes encoding Cascade in Type I-E CRISPR-Cas systems have been named with various conventions over time, which may serve as a point of confusion when comparing recent and older literature. Typically, the present Specification uses the nomenclature as set forth in Koonin, E., et al. (Curr. Opin. Microbiol. 37: 67-78 (2017)), in which the gene order in the reference E. coli K12 operon is: cas3, cas8, cas11, cas7, cas5, cas6, cas1, and cas2. For simplicity's sake, the "e" qualifier in cas8e is sometimes used to distinguish the cas8 gene between different subtypes within Type I systems. The stoichiometry of the wild-type E. coli Type I-E CRISPR-Cas is $Cas5_1$-$Cas6_1$-$Cas7_6$-$Cas8_1$-$Cas11_2$-$gRNA_1$.

However, for the purposes of cross-referencing: cas8 has been previously referred to as cse1 and casA, and also known as the "large subunit"; cas11 has been previously referred to as cse2 and casB, and also known as the "small subunit"; cas7 has been previously referred to as cse4 and casC; cas5 has been previously referred to as casD, and sometimes given the qualifier cas5e; and cas6 has been previously referred to as cse3 and casE, and often given the qualifier cas6e. Genes encoding Cas subunit proteins are listed in Table 1.

TABLE 1

Type I CRISPR-Cas Proteins

| Function | Universal family name* | Alternative designation | Reported stoichiometry (when present) |
|---|---|---|---|
| RNA 5' cap, PAM recognition, duplex unwinding | Cas5 | CasD, Cas5e, Csc1, Csy2, Csf3, Cas1822 | 1 |
| PAM recognition, duplex unwinding, Cas3 recruitment | Cas8 | Large subunit, CasA, Cse1, Cas8a, Cas8b, Cas8c, Cas8e, Cas8f, Csy1 | 1 |
| R-loop stabilization | Cas11 | Small subunit, CasB, Cse2 | 2 |
| Backbone | Cas7 | CasC, Cse4, Csc2, Csy3, Csf2, Cas1821, Cst2/DevR | 3-6 |
| RNA 3' cap | Cas6 | CasE, Cse3, Cas6e, Cas6f, Csy4 | 1 |
| DNA cleavage | Cas3 | Cas3', Cas3" | 1 |

*As defined by Makarova, K.S., et al., Nat. Rev. Microbiol. 13: 722-736 (2015); Koonin, E.V., et al., Curr Opin Microbiol. 37: 67-78 (2017).

PAM sequences are typically recognized by a Cas1 subunit protein/Cas2 subunit protein complex, wherein the active PAM-sensing site is associated with the Cas1 subunit proteins (see, e.g., Jackson, S. A., et al., Science 356:356 (6333) (2017)). Cas1 protein and Cas2 protein are present in the great majority of the known CRISPR-Cas systems and are sufficient for the insertion of spacers into CRISPR cassettes (see, e.g., Yosef, I, et al., Nucleic Acids Res. 40:5569-5576 (2012)). These two proteins form a complex for the adaptation process. The endonuclease activity of Cas1 protein is required for spacer integration whereas Cas2 protein appears to perform a non-enzymatic function (see, e.g., Nunez, J., et al., Nat Struct Mol Biol. 21:528-534 (2014); Richter, C., et al., PLoS One. 2012; 7: e49549). The Cas1-Cas2 protein complex represents a highly conserved information processing module of CRISPR-Cas systems that appears to be quasi-autonomous from the rest of the system (see, e.g., Makarova, K., et al., Methods Mol. Biol. 1311:

47-75 (2015)). The endonuclease Cas1 protein is an essential Cas protein that ensures the unique ability of CRISPR systems to keep memory of previous encounters with infectious agents.

The terms "Type I CRISPR-Cas effector complex," "Type I CRISPR-Cas nucleoprotein (NP) complex," "Cascade nucleoprotein (NP) complex," and "Type I nucleoprotein (NP) complex," are used interchangeably herein and typically refer to Cascade protein forming a complex with a guide polynucleotide. "Cascade complex" and "Type I complex," are typically used when referring to the protein components of a Cascade NP complex. The terms "Cascade RNP complex," "Type I CRISPR-Cas RNP complex," and "Type I RNP complex," refer to a Cascade complex comprising a crRNA versus a more generic guide polynucleotide (i.e., as in a Cascade NP complex). An example of a wild-type Type I CRISPR-Cas effector complex is illustrated in FIG. 1A. FIG. 1A is adapted from Makarova, K. S., et al., (Cell 168:946 (2017); Makarova, K., et al., Nature Reviews Microbiology 13:722-736 (2015)). FIG. 1A illustrates six Cas7 proteins, a Cas5 protein, a Cas8 protein, two Cse2 proteins, a Cas6 protein, and a crRNA (FIG. 1A: Cas7, Cas5, Cas8, Cse2, and Cas6; the dashed box around Cas6 indicates its interaction with the crRNA hairpin; the cRNA is illustrated as a black line comprising the hairpin) associated as a Cascade complex. The complex is capable of binding a nucleic acid target sequence. After association of a wtCas3 protein (FIG. 1A, Cas3 surrounded by a dashed box) with the complex, the Cascade complex is capable of cleavage of a nucleic acid target sequence. As noted in Table 1, the total number of some Cas subunit proteins can vary in Cascade complexes.

"Cas3" and "Cas3 protein" are used interchangeably herein to refer to Type I CRISPR-Cas3 proteins, modifications, and variants thereof. The Type I CRISPR-Cas effector complexes bind foreign DNA complementary to the crRNA guide and recruit Cas3, a trans-acting nuclease-helicase required for target degradation. Cas3 proteins have motifs characteristic of helicases from superfamily 2 and contain a DEAD/DEAH box region and a conserved C-terminal domain. Cas3 proteins and variants thereof are known in the art (see, e.g., Westra, E. R., et al., Mol. Cell. 46: 595-605 (2012); Sinkunas, T., et al., EMBO J. 30:1335-1342 (2011); Beloglazova, N., et al., EMBO J. 30:4616-4627 (2011); Mulepati, S., et al., J. Biol. Chem. 286:31896-31903 (2011)). As used herein, the term "mCas3 protein" refers to a Cas3 protein comprising one or more mutations relative to its corresponding wtCas3 protein. mCas3 proteins include, but are not limited to, mCas3 proteins (e.g., Example 23A, Example 23B, and Example 23C), dblmCas3 proteins (e.g., Example 26A, Example 26B, and Example 26C), and dCas3* (a mutated Cas3 protein that does not have any nuclease activity and/or helicase activity).

The term "nuclease," as used herein, refers to an enzyme capable of cleaving the phosphodiester bonds, such as those connecting two nucleotides, as found in double-stranded (ds) nucleic acids (e.g., dsDNA, genomic DNA (gDNA), dsRNA), single-stranded (ss) nucleic acids (e.g., ssDNA, RNA) or hybrid dsRNA/DNA. An "endonuclease" typically can affect ss-(nicks) or ds-breaks in its target molecules. One example of a DNA endonuclease is a FokI enzyme. "FokI endonuclease" and "FokI" are used interchangeably herein and refer to a FokI enzyme, FokI homologs, enzymatically active domain(s) of FokI enzymes, and variants of FokI enzymes. FokI dimerization is typically required for DNA cleavage. Dimers of FokI can comprise two monomeric subunits that associate to form a homodimer or two distinct monomeric subunits that associate to form a heterodimer (see, e.g., Bitinaite, J., et al., Proc. Natl. Acad. Sci. USA 95:10570-10575 (1998); Ramalingam, S., et al., J. Mol. Biol. 405:630-641 (2011)). One example of a FokI variant is the Sharkey variant described by Guo, et al. (Guo, J., et al., J. Mol. Biol. 400:96-107 (2010)). Additional DNA and RNA nucleases are known in the art.

Figure 1B:
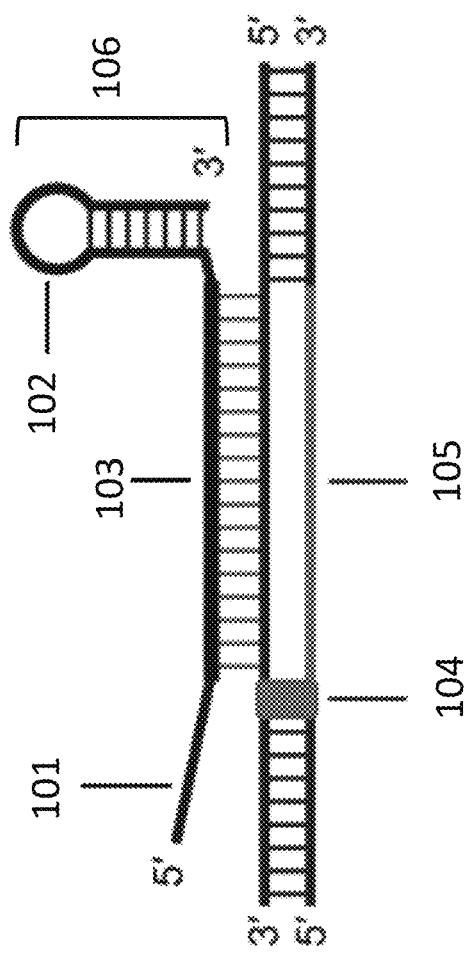
FIG. 1B presents a generalized illustration of a Type I CRISPR-Cas crRNA.

"CRISPR RNA," "crRNA," and "guide RNA," as used herein, refer to one or more RNAs with which Cas subunit proteins are capable of interacting to form a Type I effector complex that guides the complex to preferentially bind a nucleic acid target sequence in a polynucleotide (relative to a polynucleotide that does not comprise the nucleic acid target sequence). "Guide" and "guide polynucleotide," as used herein, refer to a polynucleotide component of Type I effector complexes comprising ribonucleotide bases (e.g., RNA) and ribose sugars, as well as disparate components and combinations thereof, including but not limited to deoxyribonucleotide bases, nucleotide analogs, modified nucleotides, different nitrogenous bases, fundamentally different nucleotide bases, chemically disparate molecules, intermixtures of bases (e.g., RNA bases, DNA bases, and/or modified bases), and the like as well as combinations thereof, in addition to synthetic backbones, naturally occurring backbones, non-naturally occurring backbones, fundamentally different backbone residues, chemically disparate residues or linkages, modified backbones, intermixtures (e.g., ribose and deoxyribose components of a backbone), and the like, as well as combinations thereof. Some examples of guide polynucleotides are described herein. An example of a Type I CRISPR-Cas crRNA associated with a nucleic acid target sequence through the crRNA spacer is illustrated in FIG. 1B. FIG. 1B is adapted from Hochstrasser, M. L., et al., Mol. Cell 63:840-851 (2016). In FIG. 1B, the PAM (FIG. 1B, 104) is associated with the nucleic acid target sequence and the 5' and 3' strands of a double-stranded nucleic acid are illustrated (FIG. 1B, vertical lines represent hydrogen bonds). A guide polynucleotide (FIG. 1B, 106) typically comprises a 5' handle region (FIG. 1B, 101), a spacer region (FIG. 1B, 103) comprising a seed region, and a 3' hairpin comprising two hydrogen-bonded repeat regions (FIG. 1B, 102); horizontal lines represent hydrogen bonds. PAM sequences associated with a number of Type I Cascade homologs are discussed herein. The PAM sequences are adjacent protospacer sequences (FIG. 1B, 105). FIG. 1B illustrates the Cascade complex spacer bound to the nucleic acid target sequence (FIG. 1B, vertical lines represent hydrogen bonds). FIG. 1B also illustrates the protospacer region (FIG. 1B, protospacer). The spacer can comprise a region of the crRNA between about 6 and about 56 nucleotides, wherein the spacer is complementary to a nucleic acid target sequence in a polynucleotide. The spacer length can be changed to fine-tune Cascade activity in Type I-E CRISPR-Cas systems. Cascade complexes can incorporate an extra Cas7 subunit with every 6 nucleotides added to the crRNA spacer and an extra Cse2 subunit with every 12 nucleotides added to the spacer (see, e.g., Luo, M. L., et al., Nucleic Acids Res. 44(15):7385-7394 (2016)). The spacer typically comprises a region of between about 32 and about 36 nucleotides.

The terms "spacer," "spacer sequence," and "nucleic acid target binding sequence" are used interchangeably herein.

"Target," "target sequence," "nucleic acid target sequence," and "on-target sequence" are used interchangeably herein to refer to a nucleic acid sequence that is wholly, or in part, complementary to a nucleic acid target binding sequence of the guide (e.g., the spacer of a crRNA) of a Cascade nucleoprotein complex (e.g., a Cascade RNP complex). Typically, the nucleic acid target binding sequence is selected to be 100% complementary to a nucleic acid target sequence to which binding of a Cascade nucleoprotein complex is being directed; however, to attenuate binding to a nucleic acid target sequence, lower percent complementarity can be used. When the target binding sequence is 100% complementary to the target sequence, "off-target" sequence binding refers to binding of the Cascade nucleoprotein complex to nucleic acid sequences having less than 100% complementarity to the nucleic acid target binding sequence (spacer). A double-stranded DNA sequence typically comprises a nucleic acid target sequence on one strand (FIG. 1B, section hydrogen bonded to the guide RNA). A "target region" comprises a nucleic acid target sequence.

As used herein, a "stem element" or "stem structure" refers to two strands of nucleic acids that are known to, or predicted to, form a double-stranded region (the "stem element"). A "stem-loop element" or "stem-loop structure" refers to a stem structure wherein 3'-end sequences of one strand are covalently bonded to 5'-end sequences of the second strand by a nucleotide sequence of typically single-stranded nucleotides ("a stem-loop element nucleotide sequence"). In some embodiments, the loop element comprises a loop element nucleotide sequence of between about 3 and about 20 nucleotides in length, preferably between about 4 and about 10 nucleotides in length. In preferred embodiments, a loop element nucleotide sequence is a single-stranded nucleotide sequence of unpaired nucleic acid bases that do not interact through hydrogen bond formation to create a stem element within the loop element nucleotide sequence. The term "hairpin element" is also used herein to refer to stem-loop structures. Such structures are well known in the art. The base pairing may be exact; however, as is known in the art, a stem element does not require exact base pairing. Thus, the stem element may include one or more base mismatches or non-paired bases. An example of a stem-loop structure in a guide polynucleotide is illustrated in FIG. 1B.

"Linker element nucleotide sequence," "linker nucleotide sequence," and "linker polynucleotide" are used interchangeably herein and refer to either a single-stranded nucleic acid sequence or a double-stranded nucleic acid sequence of one or more nucleotides covalently attached to a first nucleic acid sequence (e.g., 5'-linker nucleotide sequence-first nucleic acid sequence-3'). In some embodiments, a linker nucleotide sequence connects two separate nucleic acid sequences to form a single polynucleotide (e.g., 5'-first nucleic acid sequence-linker nucleotide sequence-second nucleic acid sequence-3'). Other examples of linker nucleotide sequences include, but are not limited to, 5'-first nucleic acid sequence-linker nucleotide sequence-3' and 5'-linker nucleotide sequence-first first nucleic acid sequence-linker nucleotide sequence-3'. In some embodiments, the linker element nucleotide sequence can be a single-stranded nucleotide sequence of unpaired nucleic acid bases that do not interact with each other through hydrogen bond formation to create a secondary structure (e.g., a stem-loop structure) within the linker element nucleotide sequence. In some embodiments, two linker element nucleotide sequences can interact with each other through hydrogen bonding between the two linker element nucleotide sequences. In some embodiments, a linker polynucleotide encodes a "linker polypeptide." Such a linker polynucleotide typically connects the 3' end of a first polynucleotide encoding a first polypeptide to the 5' end of a second polynucleotide encoding a second polypeptide to form a single polynucleotide that encodes a fusion protein comprising N-the first polypeptide-the linker polypeptide-the second polypeptide-C. In some embodiments of the present invention, more than two polypeptide sequences can be connected in tandem by linker polypeptides (e.g., N-a first polypeptide-a first linker polypeptide-a second polypeptide-a second linker polypeptide-a third polypeptide-C). "Linker polypeptide," "linker polypeptide sequence," "amino acid linker sequence," and "linker sequence" are also used interchangeably herein.

As used herein, a "connecting nucleotide sequence" refers to a single-stranded nucleic acid sequence linker sequence that covalently connects a first nucleic acid sequence and a second nucleic acid sequence.

Figure 2C:
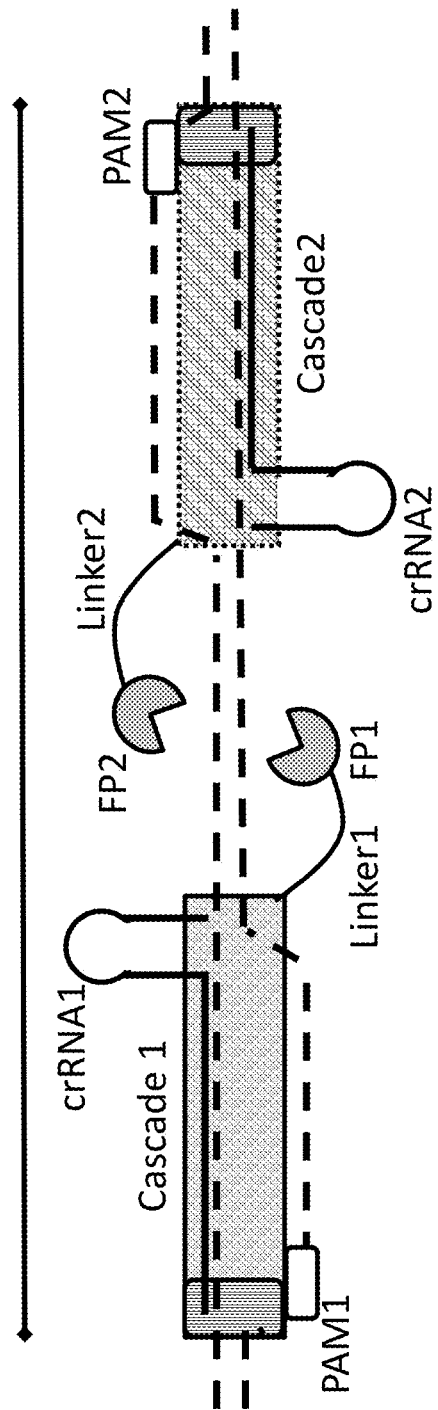

As used herein, the terms "interspacer," "interspacer region," and "interspacer distance" are interchangeable and refer to the distance between a PAM of a first nucleic acid target sequence (e.g., a first DNA target sequence) and a PAM of a second nucleic acid target sequence (e.g., a second DNA target sequence) typically in a PAM-in orientation, wherein a first Type I CRISPR-Cas effector complex comprises a first spacer capable of binding the first nucleic acid target sequence, and a second Type I CRISPR-Cas effector complex comprises a second spacer capable of binding the second nucleic acid target sequence. FIG. 2A, FIG. 2B, and FIG. 2C present illustrative examples of two Type I CRISPR-Cas effector complexes (FIG. 2A: "Cascade1," solid outlined box, comprising "crRNA1"; and "Cascade2," dashed box, comprising "crRNA2") comprising fusion proteins (FIG. 2A, "FP1" and "FP2" represented as circular sectors; e.g., FP1 and FP can be FokI) connected with each Cascade complex through linker polynucleotides (FIG. 2A, "Linker1" and "Linker2"), wherein the CRISPR-Cas effector complexes are bound to neighboring nucleic acid target sequences on double-stranded DNA (FIG. 2A, "dsDNA," represented as paired, horizontal dashed lines). PAM sequences associated with each nucleic acid target sequence are indicated (FIG. 2A, "PAM1," open box, and "PAM2," open box)). FIG. 2A illustrates an interspacer (shown as a horizontal, double-arrowheaded line at the top of FIG. 2A) between two target sites in a PAM-in (PAM-in/PAM-in) configuration. FIG. 2B illustrates an interspacer (shown as a horizontal, double-arrowheaded line at the top of FIG. 2B) between two target sites in a PAM-in/PAM-out configuration. FIG. 2C illustrates an interspacer (shown as a horizontal, double-arrowheaded line at the top of FIG. 2C) between two target sites in the PAM-out (PAM-out/PAM-out) configuration. FIG. 2A, FIG. 2B, and FIG. 2C also illustrate the separation of the two strands of the dsDNA. A Cascade complex recognizes a dsDNA target sequence adjacent a PAM. PAM sequences are recognized by Cse1. Base pairing between the crRNA and complementary target DNA strand results in an R-loop with the displaced non-complementary target DNA strand (see, e.g., Beloglazova, N., et al., Nucleic Acids Res. 43:530-543 (2015)).

As used herein, the term "cognate" refers to biomolecules that interact, such as a cell surface receptor (e.g., a chemokine receptor), and its ligand (e.g., a chemokine expressed on a tumor cell or in a tumor microenvironment); a site-directed polypeptide and its guide; a site-directed polypeptide/guide complex (i.e., a nucleoprotein complex) capable of site-directed binding to a nucleic acid target sequence complementary to the guide binding sequence; and the like. In addition, the term "cognate" refers to a group of Cas subunit proteins (e.g., Cse2, Cas5, Cas6, Cas7, and Cas8) and one or more guide polynucleotides (e.g., a Type I CRISPR-Cas RNA) that are capable of forming a nucleoprotein complex capable of site-directed binding to a nucleic acid target sequence complementary to a spacer present in one of the one or more guide polynucleotides.

The terms "wild-type," "naturally occurring," and "unmodified" are used herein to mean the typical (or most common) form, appearance, phenotype, or strain existing in nature; for example, the typical form of cells, organisms, polynucleotides, proteins, macromolecular complexes, genes, RNAs, DNAs, or genomes as they occur in, and can be isolated from, a source in nature. The wild-type form, appearance, phenotype, or strain serve as the original parent before an intentional modification, change, mutation, and/or markedly different structural change. Thus, mutant, variant, engineered, recombinant, and modified forms are not wild-type forms.

The terms "engineered," "genetically engineered," "genetically modified," "recombinant," "modified," "non-naturally occurring," and "non-native" indicate intentional human or machine manipulation of the genome of an organism or cell. The terms encompass methods of genomic modification that include genomic editing, as defined herein, as well as techniques that alter gene expression or inactivation, enzyme engineering, directed evolution, knowledge-based design, random mutagenesis methods, gene shuffling, codon optimization, and the like. Methods for genetic engineering are known in the art.

"Covalent bond," "covalently attached," "covalently bound," "covalently linked," "covalently connected," and "molecular bond" are used interchangeably herein and refer to a chemical bond that involves the sharing of electron pairs between atoms. Examples of covalent bonds include, but are not limited to, phosphodiester bonds, phosphorothioate bonds, disulfide bonds and peptide bonds (—CO—NH—).

"Non-covalent bond," "non-covalently attached," "non-covalently bound," "non-covalently linked," "non-covalent interaction," and "non-covalently connected" are used interchangeably herein and refer to any relatively weak chemical bond that does not involve sharing of a pair of electrons. Multiple non-covalent bonds often stabilize the conformation of macromolecules and mediate specific interactions between molecules. Examples of non-covalent bonds include, but are not limited to, hydrogen bonding, ionic interactions (e.g., Na$^+$Cl$^-$), van der Waals interactions, and hydrophobic bonds.

As used herein, "hydrogen bonding," "hydrogen-base pairing," and "hydrogen bonded" are interchangeable and refer to canonical hydrogen bonding and non-canonical hydrogen bonding including, but not limited to, "Watson-Crick-hydrogen-bonded base pairs" (W-C-hydrogen-bonded base pairs or W-C hydrogen bonding); "Hoogsteen-hydrogen-bonded base pairs" (Hoogsteen hydrogen bonding); and "wobble-hydrogen-bonded base pairs" (wobble hydrogen bonding). W-C hydrogen bonding, including reverse W-C hydrogen bonding, refers to purine-pyrimidine base pairing, e.g., adenine:thymine, guanine:cytosine, and uracil:adenine. Hoogsteen hydrogen bonding, including reverse Hoogsteen hydrogen bonding, refers to a variation of base pairing in nucleic acids wherein two nucleobases, one on each strand, are held together by hydrogen bonds in the major groove. This non-W-C hydrogen bonding can allow a third strand to wind around a duplex and form triple-stranded helices. Wobble hydrogen bonding, including reverse wobble hydrogen bonding, refers to a pairing between two nucleotides in RNA molecules that does not follow Watson-Crick base pair rules. There are four major wobble base pairs: guanine:uracil, inosine (hypoxanthine):uracil, inosine-adenine, and inosine-cytosine. Rules for canonical hydrogen bonding and non-canonical hydrogen bonding are known to those of ordinary skill in the art (see, e.g., The RNA World, Third Edition (Cold Spring Harbor Monograph Series), R. F. Gesteland, Cold Spring Harbor Laboratory Press (2005), ISBN 978-0879697396; The RNA World, Second Edition (Cold Spring Harbor Monograph Series), R. F. Gesteland, et al., Cold Spring Harbor Laboratory Press (1999), ISBN 978-0879695613; The RNA World (Cold Spring Harbor Monograph Series), R. F. Gesteland, et al., Cold Spring Harbor Laboratory Press (1993), ISBN 978-0879694562 (see, e.g., Appendix 1: Structures of Base Pairs Involving at Least Two Hydrogen Bonds, I. Tinoco); Principles of Nucleic Acid Structure, W. Saenger, Springer International Publishing AG (1988), ISBN 978-0-387-90761-1; Principles of Nucleic Acid Structure, First Edition, S. Neidle, Academic Press (2007), ISBN 978-01236950791).

"Connect," "connected," and "connecting" are used interchangeably herein and refer to a covalent bond or a non-covalent bond between two macromolecules (e.g., polynucleotides, proteins, and the like).

As used herein, the terms "nucleic acid sequence," "nucleotide sequence," and "oligonucleotide" are interchangeable and refer to a polymeric form of nucleotides. As used herein, the term "polynucleotide" refers to a polymeric form of nucleotides that has one 5' end and one 3' end, and can comprise one or more nucleic acid sequences. A "circular polynucleotide" refers to a polynucleotide having a covalent bond between its 5' end and its 3' end, thus forming the circular polynucleotide. The nucleotides may be deoxyribonucleotides (DNA), ribonucleotides (RNA), analogs thereof, or combinations thereof (e.g., as described above in the context of guide polynucleotides), and may be of any length. Polynucleotides may perform any function and may have various secondary and tertiary structures. The terms encompass known analogs of natural nucleotides and nucleotides that are modified in the base, sugar, and/or phosphate moieties. Analogs of a particular nucleotide have the same base-pairing specificity (e.g., an analog of A base pairs with T). A polynucleotide may comprise one modified nucleotide or multiple modified nucleotides. Examples of modified nucleotides include, but are not limited to, fluorinated nucleotides, methylated nucleotides, and nucleotide analogs. Nucleotide structure may be modified before or after a polymer is assembled. Following polymerization, polynucleotides may be additionally modified via, for example, conjugation with a labeling component or target binding component. A nucleotide sequence may incorporate non-nucleotide components. Also encompassed are nucleic acids comprising modified backbone residues or linkages, that are synthetic, naturally occurring, and/or non-naturally occurring, and have similar binding properties as a reference polynucleotide (e.g., DNA or RNA). Examples of such analogs include, but are not limited to, phosphorothioates, phosphoramidates, methyl phosphonates, chiral-methyl phosphonates, 2-O-methyl ribonucleotides, peptide-nucleic acids (PNAs), Locked Nucleic Acid (LNA™) (Exiqon, Inc., Woburn, MA) nucleosides, glycol nucleic acid, bridged nucleic acids, and morpholino structures.

Peptide-nucleic acids (PNAs) are synthetic homologs of nucleic acids wherein the polynucleotide phosphate-sugar backbone is replaced by a flexible pseudo-peptide polymer, and nucleobases are linked to the polymer. PNAs have the capacity to hybridize with high affinity and specificity to complementary sequences of RNA and DNA.

In phosphorothioate nucleic acids, the phosphorothioate (PS) bond replaces a sulfur atom with a non-bridging oxygen in the polynucleotide phosphate backbone. This modification makes the internucleotide linkage resistant to nuclease degradation. In some embodiments, phosphorothioate bonds are introduced between the last 3 to 5 nucleotides at the 5'-end or the 3'-end of a polynucleotide sequence to inhibit exonuclease degradation. Placement of phosphorothioate bonds throughout an entire oligonucleotide helps reduce degradation by endonucleases, as well.

Threose nucleic acid (TNA) is an artificial genetic polymer. The backbone structure of TNA comprises repeating threose sugars linked by phosphodiester bonds. TNA polymers are resistant to nuclease degradation. TNA can self-assemble by base-pair hydrogen bonding into duplex structures.

Linkage inversions can be introduced into polynucleotides through use of "reversed phosphoramidites" (see, e.g., www.ucalgary.ca/dnalab/synthesis/-modifications/linkages). A 3'-3' linkage at a terminus of a polynucleotide stabilizes the polynucleotide to exonuclease degradation by creating an oligonucleotide having two 5'-OH termini but lacking a 3'-OH terminus. Typically, such polynucleotides have phosphoramidite groups on the 5'-OH position and a dimethoxytrityl (DMT) protecting group on the 3'-OH position. Normally, the DMT protecting group is on the 5'-OH and the phosphoramidite is on the 3'-OH.

Polynucleotide sequences are displayed herein in the conventional 5' to 3' orientation unless otherwise indicated.

As used herein, "sequence identity" generally refers to the percent identity of nucleotide bases or amino acids comparing a first polynucleotide or polypeptide to a second polynucleotide or polypeptide using algorithms having various weighting parameters. Sequence identity between two polynucleotides or two polypeptides can be determined using sequence alignment by various methods and computer programs (e.g., BLAST, CS-BLAST, PSI-BLAST, FASTA, HMMER, L-ALIGN, and the like) available through the worldwide web at sites including, but not limited to, GENBANK (www.ncbi.nlm.nih.gov/genbank/) and EMBL-EBI (www.ebi.ac.uk). Sequence identity between two polynucleotides or two polypeptide sequences is generally calculated using the standard default parameters of the various methods or computer programs. A high degree of sequence identity, as used herein, between two polynucleotides or two polypeptides is typically between about 90% identity and 100% identity, for example, about 90% identity or higher, preferably about 95% identity or higher, more preferably about 98% identity or higher. A moderate degree of sequence identity, as used herein, between two polynucleotides or two polypeptides is typically between about 80% identity to about 85% identity, for example, about 80% identity or higher, preferably about 85% identity. A low degree of sequence identity, as used herein, between two polynucleotides or two polypeptides is typically between about 50% identity and 75% identity, for example, about 50% identity, preferably about 60% identity, more preferably about 75% identity. For example, a Cas protein (e.g., Type I-E Cse2, Cas5, Cas6, Cas7, and/or Cas8) comprising amino acid substitutions can have a low degree of sequence identity, a moderate degree of sequence identity, or a high degree of sequence identity over its length to a reference Cas protein (e.g., wild-type Type I-E Cse2, Cas5, Cas6, Cas7, and/or Cas8, respectively). As another example, a guide polynucleotide can have a low degree of sequence identity, a moderate degree of sequence identity, or a high degree of sequence identity over its length compared with a reference wild-type guide polynucleotide that complexes with the reference Cas proteins (e.g., a guide polynucleotide that forms a complex with a Type I-E Cse2, Cas5, Cas6, Cas7, and/or Cas8).

As used herein, "hybridization" "hybridize," or "hybridizing" is the process of combining two complementary single-stranded DNA or RNA molecules so as to form a single double-stranded molecule (DNA/DNA, DNA/RNA, RNA/RNA) through hydrogen base pairing. Hybridization stringency is typically determined by the hybridization temperature and the salt concentration of the hybridization buffer; e.g., high temperature and low salt provide high stringency hybridization conditions. Examples of salt concentration ranges and temperature ranges for different hybridization conditions are as follows: high stringency, approximately 0.01M to approximately 0.05M salt, hybridization temperature 5° C. to 10° C. below $T_m$; moderate stringency, approximately 0.16M to approximately 0.33M salt, hybridization temperature 20° C. to 29° C. below $T_m$; and low stringency, approximately 0.33M to approximately 0.82M salt, hybridization temperature 40° C. to 48° C. below $T_m$. $T_m$ of duplex nucleic acid sequences is calculated by standard methods well known in the art (see, e.g., Maniatis, T., et al., Molecular Cloning: A Laboratory Manual, Cold Spring Harbor Laboratory Press: New York (1982); Casey, J., et al., Nucleic Acids Res. 4:1539-1552 (1977); Bodkin, D. K., et al., J. Virological Methods 10:45-52 (1985); Wallace, R. B., et al., Nucleic Acids Res. 9:879-894 (1981)). Algorithm prediction tools to estimate $T_m$ are also widely available. High stringency conditions for hybridization typically refer to conditions under which a polynucleotide complementary to a target sequence predominantly hybridizes with the target sequence and substantially does not hybridize to non-target sequences. Typically, hybridization conditions are of moderate stringency, preferably high stringency.

As used herein, "complementarity" refers to the ability of a nucleic acid sequence to form hydrogen bond(s) with another nucleic acid sequence (e.g., through canonical Watson-Crick base pairing). A percent complementarity indicates the percentage of residues in a nucleic acid sequence that can form hydrogen bonds with a second nucleic acid sequence. If two nucleic acid sequences have 100% complementarity, the two sequences are perfectly complementary, i.e., all of the contiguous residues of a first polynucleotide hydrogen bond with the same number of contiguous residues in a second polynucleotide.

As used herein, "binding" refers to a non-covalent interaction between macromolecules (e.g., between a protein and a polynucleotide, between a polynucleotide and a polynucleotide, between a protein and a protein, and the like). Such non-covalent interaction is also referred to as "associating" or "interacting" (e.g., if a first macromolecule interacts with a second macromolecule, the first macromolecule binds to the second macromolecule in a non-covalent manner). Some portions of a binding interaction may be sequence-specific (the terms "sequence-specific binding," "sequence-specifically bind," "site-specific binding," and "site specifically binds" are used interchangeably herein). Sequence-specific binding, as used herein, typically refers to one or more guide polynucleotides capable of forming a complex with Type I CRISPR-Cas subunit proteins (e.g., Cse2, Cas5, Cas6, Cas7, and Cas8) to cause the protein to bind a nucleic acid sequence (e.g., a DNA sequence) comprising a nucleic acid target sequence (e.g., a DNA target sequence) preferentially relative to a second nucleic acid sequence (e.g., a second DNA sequence) without the nucleic acid target binding sequence (e.g., the DNA target binding sequence). All components of a binding interaction do not need to be sequence-specific, such as contacts of a protein with phosphate residues in a DNA backbone. Binding interactions can be characterized by a dissociation constant (Kd). "Binding affinity" refers to the strength of the binding interaction. An increased binding affinity is correlated with a lower Kd.

As used herein, effector complexes are said to "target" a polynucleotide if such a complex binds or cleaves a polynucleotide in the nucleic acid target sequence within the polynucleotide.

As used herein, a "double-strand break" (DSB) refers to both strands of a double-stranded segment of DNA being severed. In some instances, if such a break occurs, one strand can be said to have a "sticky end" wherein nucleotides are exposed and not hydrogen bonded to nucleotides on the other strand. In other instances, a "blunt end" can occur wherein both strands remain fully base paired with each other.

"Donor polynucleotide," "donor oligonucleotide," and "donor template" are used interchangeably herein and can be a double-stranded polynucleotide (e.g., DNA), a single-stranded polynucleotide (e.g., DNA or RNA), or a combination thereof. Donor polynucleotides can comprise homology arms flanking the insertion sequence (e.g., DSBs in the DNA). The homology arms on each side can vary in length (e.g., 1-50 bases, 50-100 bases, 100-200 bases, 200-300 bases, 300-500 bases, 500-1000 bases). Homology arms can be symmetric or asymmetric in length. Parameters for the design and construction of donor polynucleotides are well known in the art (see, e.g., Ran, F., et al., Nature Protocols 8:2281-2308 (2013); Smithies, O., et al., Nature 317:230-234 (1985); Thomas, K., et al., Cell 44:419-428 (1986); Wu, S., et al., Nature Protocols 3:1056-1076 (2008); Singer, B., et al., Cell 31:25-33 (1982); Shen, P., et al., Genetics 112:441-457 (1986); Watt, V., et al., Proc. Natl. Acad. Sci. USA 82:4768-4772 (1985); Sugawara, N., et al., J. Mol. Bio. 12:563-575 (1992); Rubnitz, J., et al., J. Mol. Bio. 4:2253-2258 (1984); Ayares, D., et al., Proc. Natl. Acad. Sci. USA 83:5199-5203 (1986); Liskay, R., et al., Genetics 115:161-167 (1987)). In some embodiments, a donor polynucleotide comprises a chimeric antigen receptor (e.g., a CAR).

The terms "chimeric antigen receptor" and "CAR" are used interchangeably herein and refer a polypeptide molecule created in the laboratory typically comprising at least two components: an extracellular antigen-recognizing domain (also referred to as a target-binding domain or extracellular ligand binding domain) and an intracellular activation domain (e.g., comprising one or more intracellular signaling domain and typically one or more co-stimulatory signaling domain). A CAR can further comprise a hinge domain and a transmembrane domain. The structure of a typical CAR polypeptide is as follows: N terminus-extracellular-[antigen-recognizing domain-hinge domain]-transmembrane-[transmembrane domain]-intracellular-[intracellular activation domain]-C terminus; or N terminus-intracellular-[intracellular activation domain]-transmembrane-[transmembrane domain]-extracellular-[antigen-recognizing domain-hinge domain]-C terminus.

Examples of extracellular antigen-recognizing domains comprise moieties used to bind to antigen and include, but are not limited to, single-chain immunoglobulin variable fragment (scFv), an antigen-binding fragment (Fab; typically a region of an antibody that binds an antigen and is composed of one constant and one variable domain of each of the heavy and the light chains), nanobodies, Camelidae family- or shark-derived single chain antibodies, engineered protein binding scaffolds (e.g., DARPins and Centyrins), or natural ligand(s) that bind to their cognate receptor(s).

Examples of hinge domains include, but are not limited to, a polypeptide hinge of variable length (e.g., one or more amino acids), a hinge region of CD8 alpha, a hinge region of CD28, a hinge region of IgG4, and combinations thereof.

Examples of transmembrane domains include, but are not limited to, a transmembrane region derived from a transmembrane protein, such as, CD8 alpha, CD28, DAP10, DAP12, NKG2D, and combinations thereof.

Examples of intracellular activation domains include, but are not limited to, an intracellular signaling domain of CD28, 4-1BB, CD3 zeta, OX40, 2B4, DAP10, DAP12, truncated and mutated signaling domains (e.g., mutations and truncations in the three ITAM domains of CD3 zeta), or other intracellular signaling domains, and combinations thereof.

When the extracellular ligand binding domain binds to a cognate ligand, the intracellular signaling domain of the CAR activates the lymphocyte (for description of CAR-T cells, see, e.g., Brudno, J., et al., Nature Rev. Clin. Oncol. 15:31-46 (2018); Maude, S., et al., N. Engl. J. Med. 371: 1507-1517 (2014); Sadelain, M., et al., Cancer Disc. 3:388-398 (2013); U.S. Pat. Nos. 7,446,190; 8,399,645) (for descriptions of CAR-NK cells, see, e.g., Rezvani, K., et al., Mol. Ther., 25:1769-1781 (2017); Siegler, E., et al., Cell Stem Cell. 23:160-161 (2018); Li, Y., et al., Cell Stem Cell. 23:181-192 (2018); Lin, C., et al., Biochim. Biophys. Acta. Rev. Cancer. 1869:200-215 (2018); Hu, Y., et al., Acta. Pharmacol. Sin. 39:167-176 (2018); Fang, F., et al., Semin. Immunol. 31:37-54 (2017); Glienke, W., et al., Front Pharmacol. 6:21 (2015)).

Table 2 presents exemplary cellular targets and scFvs/binding proteins that bind the cellular targets. Such scFvs/binding proteins or portions thereof can be incorporated into CAR constructs.

TABLE 2

Exemplary Cellular Targets and CAR scFv Binding Proteins

| Cellular target | CAR scFv/binding protein |
|---|---|
| CD19 | anti-CD19 |
| CD20 | anti-CD20 |
| CD22 | anti-CD22 |
| CD30 | anti-CD30 |
| CD33 | anti-CD33 |
| CD37 | anti-CD37 |
| CD43 | anti-CD43 |
| CD138 | anti-CD138 |
| CD171/L1CAM | anti-CD171 |
| CEA | anti-CEA |
| CD123 | anti-CD123 |
| B-cell activating factor receptor (BAFF-R) [also called, Tumor necrosis factor receptor superfamily member 13C (TNFRSF13C); BLyS receptor 3 (BR3); and CD268 | Anti-BAFF-R |
| IL13 Receptor alpha | IL13 |
| Epidermal growth factor receptor | anti-Epidermal growth factor receptor |
| EFGRvIII | anti-EFGRvIII |
| ErbB | anti-ErbB |
| FAP | anti-FAP |
| GD2 | anti-GD2 |
| Glypican 3 | anti-Glypican 3 |
| Her2 | anti-Her2 |
| Mesothelin | anti-Mesothelin |
| ULBP and MICA/B proteins | NKG2D |
| PD1 | anti-PD1 |
| MUC1 | anti-MUC1 |
| VEGF2 | anti-VEGF2 |
| SLAMF7 | anti-SLAMF7 |
| BCMA | anti-BCMA |
| WT1 | anti-WT1 |
| MUC16 | anti-MUC16 |

TABLE 2-continued

Exemplary Cellular Targets and CAR scFv Binding Proteins

| Cellular target | CAR scFv/binding protein |
| --- | --- |
| LewisY/LeY | anti-LeY |
| FLT3 | FLT3 ligand or anti-FLT3 |
| ROR1 | anti-ROR1 |
| Claudin18 | Anti-Claudin18 |
| Claudin6 | Anti-Claudin6 |

As used herein, "homology-directed repair" (HDR) refers to DNA repair that takes place in cells, for example, during repair of a DSB in gDNA. HDR requires nucleotide sequence homology and uses a donor or template polynucleotide to repair the sequence wherein the DSB (e.g., within a DNA target sequence) occurred. The donor polynucleotide generally has the requisite sequence homology with the sequence flanking the DSB so that the donor polynucleotide can serve as a suitable template for repair. HDR results in the transfer of genetic information from, for example, the donor polynucleotide to the DNA target sequence. HDR may result in alteration of the DNA target sequence (e.g., insertion, deletion, or mutation) if the donor polynucleotide sequence differs from the DNA target sequence and part or all of the donor polynucleotide is incorporated into the DNA target sequence. In some embodiments, an entire donor polynucleotide, a portion of the donor polynucleotide, or a copy of the donor polynucleotide is integrated at the site of the DNA target sequence. For example, a donor polynucleotide can be used for repair of the break in the DNA target sequence, wherein the repair results in the transfer of genetic information from the donor polynucleotide at the site or in close proximity of the break in the DNA. Accordingly, new genetic information may be inserted or copied at a DNA target sequence.

A "genomic region" is a segment of a chromosome in the genome of a host cell that is present on either side of the nucleic acid target sequence site or, alternatively, also includes a portion of the nucleic acid target sequence site. The homology arms of the donor polynucleotide have sufficient homology to undergo homologous recombination with the corresponding genomic regions. In some embodiments, the homology arms of the donor polynucleotide share significant sequence homology to the genomic region immediately flanking the nucleic acid target sequence site; it is recognized that the homology arms can be designed to have sufficient homology to genomic regions farther from the nucleic acid target sequence site.

As used herein, "non-homologous end joining" (NHEJ) refers to the repair of a DSB in DNA by direct ligation of one terminus of the break to the other terminus of the break without a requirement for a donor polynucleotide. NHEJ is a DNA repair pathway available to cells to repair DNA without the use of a repair template. NHEJ in the absence of a donor polynucleotide often results in nucleotides being randomly inserted or deleted at the site of the DSB.

"Microhomology-mediated end joining" (MMEJ) is pathway for repairing a DSB in gDNA. MMEJ involves deletions flanking a DSB and alignment of microhomologous sequences internal to the break site before joining. MMEJ is genetically defined and requires the activity of, for example, CtIP, Poly(ADP-Ribose) Polymerase 1 (PARP1), DNA polymerase theta (Pol θ), DNA Ligase 1 (Lig 1), or DNA Ligase 3 (Lig 3). Additional genetic components are known in the art (see, e.g., Sfeir, A., et al., Trends in Biochemical Sciences 40:701-714 (2015)).

As used herein, "DNA repair" encompasses any process whereby cellular machinery repairs damage to a DNA molecule contained in the cell. The damage repaired can include single-strand-breaks or DSBs. At least three mechanisms exist to repair DSBs: HDR, NHEJ, and MMEJ. "DNA repair" is also used herein to refer to DNA repair resulting from human or machine manipulation, wherein a target locus is modified, e.g., by inserting, deleting, or substituting nucleotides, all of which represent forms of genome editing.

As used herein, "recombination" refers to a process of exchange of genetic information between two polynucleotides.

As used herein, the terms "regulatory sequences," "regulatory elements," and "control elements" are interchangeable and refer to polynucleotide sequences that are upstream (5' non-coding sequences), within, or downstream (3' non-translated sequences) of a polynucleotide target to be expressed. Regulatory sequences influence, for example, the timing of transcription; the amount or level of transcription; RNA processing or stability; and/or translation of the related structural nucleotide sequence. Regulatory sequences may include activator binding sequences, enhancers, introns, polyadenylation recognition sequences, promoters, transcription start sites, repressor binding sequences, stem-loop structures, translational initiation sequences, internal ribosome entry sites (IRES), translation leader sequences, transcription termination sequences (e.g., polyadenylation signals and poly-U sequences), translation termination sequences, primer binding sites, and the like.

Regulatory elements include those that direct constitutive, inducible, and repressible expression of a nucleotide sequence in many types of host cells and those that direct expression of the nucleotide sequence only in certain host cells (e.g., tissue-specific regulatory sequences). In some embodiments, a vector comprises one or more pol III promoters, one or more pol II promoters, one or more pol I promoters, or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer; see, e.g., Boshart, M., et al., Cell 41:521-530 (1985)), the SV40 promoter, the dihydrofolate reductase promoter, the β-actin promoter, the phosphoglycerol kinase (PGK) promoter, and the EF1α promoter, as well as engineered artificial promoters (e.g., the MND promoter and the CAG promoter). It will be appreciated by those skilled in the art that the design of an expression vector may depend on such factors as the choice of the host cell to be transformed, the level of expression desired, and the like. A vector can be introduced into host cells to thereby produce RNA transcripts, proteins, or peptides, including fusion proteins or peptides, encoded by nucleic acid sequences as described herein.

"Gene," as used herein, refers to a polynucleotide sequence comprising exon(s) and related regulatory sequences. A gene may further comprise intron(s) and/or untranslated region(s) (UTR(s)).

As used herein, the term "operably linked" refers to polynucleotide sequences or amino acid sequences placed into a functional relationship with one another. For example, regulatory sequences (e.g., a promoter or enhancer) are "operably linked" to a polynucleotide encoding a gene product if the regulatory sequences regulate or contribute to the modulation of the transcription of the polynucleotide. Operably linked regulatory elements are typically contiguous with the coding sequence. However, enhancers can function if separated from a promoter by up to several kilobases or more. Additionally, multicistronic constructs can include multiple coding sequences that use only one promoter by including a 2A self-cleaving peptide, an IRES element, etc. Accordingly, some regulatory elements may be operably linked to a polynucleotide sequence but not contiguous with the polynucleotide sequence. Similarly, translational regulatory elements contribute to the modulation of protein expression from a polynucleotide.

As used herein, "expression" refers to transcription of a polynucleotide from a DNA template, resulting in, for example, a messenger RNA (mRNA) or other RNA transcript (e.g., non-coding, such as structural or scaffolding RNAs). The term further refers to the process through which transcribed mRNA is translated into peptides, polypeptides, or proteins. Transcripts and encoded polypeptides may be referred to collectively as "gene product(s)." Expression may include splicing the mRNA in a eukaryotic cell, if the polynucleotide is derived from gDNA.

A "coding sequence" or a sequence that "encodes" a selected polypeptide, is a nucleic acid molecule that is transcribed (in the case of DNA) and translated (in the case of mRNA) into a polypeptide in vitro or in vivo when placed under the control of appropriate regulatory sequences. The boundaries of the coding sequence are determined by a start codon at the 5' terminus and a translation stop codon at the 3' terminus.

By "artificial transcriptional activator (ATA)" or an "artificial transcription factor (ATF)," as used herein, is meant a complex capable of recruiting RNA polymerase II holoenzyme to genes with which they are associated thereby causing ectopic expression of the gene of interest. Such activators include at least two components: (1) a catalytically inactive polynucleotide binding domain that either directly recognizes cognate nucleotide sequences and can bind to these sequences, or a polynucleotide binding domain that is guided to such sequences for binding (e.g., a nucleoprotein complex comprising a nucleic acid binding domain and a guide as described herein); and (2) an activation domain (also termed "effector domain") that interacts with a variety of proteins that constitute the transcriptional machinery to upregulate transcription.

By "catalytically inactive polynucleotide binding domain" is meant a molecule that binds to, but does not cleave, the nucleic acid target site bound by the binding domain. Representative examples of such domains are detailed herein.

As used herein, the term "modulate" refers to a change in the quantity, degree, or amount of a function. For example, a Type I CRISPR nucleoprotein complex, as disclosed herein, may modulate the activity of a promoter sequence by binding to a nucleic acid target sequence at or near the promoter or a transcriptional start site or regulator site. Depending on the action occurring after binding, the Type I CRISPR nucleoprotein complex can induce, enhance, suppress, or inhibit transcription of a gene operatively linked to the promoter sequence. Thus, "modulation" of gene expression includes both gene activation and gene repression.

Modulation can be assayed by determining any characteristic directly or indirectly affected by the expression of the target gene. Such characteristics include, for example, changes in RNA or protein levels, protein activity, product levels, expression of the gene, or activity level of reporter genes. Accordingly, the terms "modulating expression," "inhibiting expression," and "activating expression" of a gene can refer to the ability of a Type I CRISPR nucleoprotein complex to change, activate, or inhibit transcription of a gene.

A function (e.g., an enzymatic function) can be up-modulated (e.g., increase, strengthen, amplify, or enhance the function) or down-modulated (e.g., decrease, weaken, diminish, or lessen the function). In one embodiment, binding of a mCas3 protein to single-stranded DNA (ssDNA) or ATP binding/hydrolysis by a mCas3 protein can be up-modulated or down-modulated relative to the corresponding wtCas3 protein.

"Vector" and "plasmid," as used herein, refer to a polynucleotide vehicle to introduce genetic material into a cell. Vectors can be linear or circular. Vectors can contain a replication sequence capable of effecting replication of the vector in a suitable host cell (e.g., an origin of replication). Upon transformation of a suitable host, the vector can replicate and function independently of the host genome or integrate into the host genome. Vector design depends, among other things, on the intended use and host cell for the vector, and the design of a vector of the invention for a particular use and host cell is within the level of skill in the art. The four major types of vectors are plasmids, viral vectors, cosmids, and artificial chromosomes. Typically, vectors comprise an origin of replication, a multicloning site, and/or a selectable marker. An expression vector typically comprises an expression cassette. By "recombinant virus" is meant a virus that has been genetically altered, e.g., by the addition or insertion of a heterologous nucleic acid construct into a viral genome or portion thereof.

As used herein, "expression cassette" refers to a polynucleotide construct generated using recombinant methods or by synthetic means and comprising regulatory sequences operably linked to a selected polynucleotide to facilitate expression of the selected polynucleotide in a host cell. For example, the regulatory sequences can facilitate transcription of the selected polynucleotide in a host cell, or transcription and translation of the selected polynucleotide in a host cell. An expression cassette can, for example, be integrated in the genome of a host cell or be present in a vector to form an expression vector.

As used herein, a "targeting vector" is a recombinant DNA construct typically comprising tailored DNA arms, homologous to gDNA, that flank elements of a target gene or nucleic acid target sequence (e.g., a DSB). A targeting vector comprises a donor polynucleotide. Elements of the target gene can be modified in a number of ways, including deletions and/or insertions. A defective target gene can be replaced by a functional target gene, or in the alternative a functional gene can be knocked out. Optionally, the donor polynucleotide of a targeting vector comprises a selection cassette comprising a selectable marker that is introduced into the target gene. Targeting regions (comprising nucleic acid target sequences) adjacent or within a target gene can be used to affect regulation of gene expression.

As used herein, the term "between" is inclusive of end values in a given range (e.g., between 1 and 50 nucleotides in length includes 1 nucleotide and 50 nucleotides; between 5 amino acids and 50 amino acids in length includes 5 amino acids and 50 amino acids).

As used herein, the term "amino acid" (aa) refers to natural and synthetic (unnatural) amino acids, including amino acid analogs, modified amino acids, peptidomimetics, glycine, and D or L optical isomers.

As used herein, the terms "peptide," "polypeptide," "protein," and "subunit protein" are interchangeable and refer to polymers of amino acids. A polypeptide may be of any length. It may be branched or linear, it may be interrupted by non-amino acids, and it may comprise modified amino acids. The terms also refer to an amino acid polymer that has been modified through, for example, acetylation, disulfide bond formation, glycosylation, lipidation, phosphorylation, pegylation, biotinylation, cross-linking, and/or conjugation (e.g., with a labeling component or ligand). Polypeptide sequences are displayed herein in the conventional N-terminal to C-terminal orientation, unless otherwise indicated.

Polypeptides and polynucleotides can be made using routine techniques in the field of molecular biology (see, e.g., standard texts listed above). Furthermore, essentially any polypeptide or polynucleotide is available from commercial sources.

The terms "fusion protein" and "chimeric protein," as used herein, refer to a single protein created by joining two or more proteins, protein domains, protein fragments, or circular permuted polypeptides that do not naturally occur together in a single protein. In some embodiments, a linker polynucleotide can be used to connect a first protein, protein domains, or protein fragments, or circular permuted polypeptides to a second protein, protein domains, protein fragments, or circular permuted polypeptides. For example, a fusion protein can comprise a Type I CRISPR-Cas protein (e.g., Cas8, Cas3) and a functional domain from another protein (e.g., FokI; see, e.g., U.S. Pat. No. 9,885,026). The modification to include such domains in fusion proteins may confer additional activity on engineered Type I CRISPR-Cas proteins. Such activities can include nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity, glycosylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, and/or myristoylation activity or demyristoylation activity that modifies a polypeptide associated with nucleic acid target sequence (e.g., a histone).

In some embodiments, a fusion protein can comprise epitope tags (e.g., histidine tags, HA tags, FLAG® (Sigma Aldrich, St. Louis, MO) tags, Myc tags, nuclear localization signal (NLS) tags, SunTag), reporter protein sequences (e.g., glutathione-S-transferase, beta-galactosidase, luciferase, green fluorescent protein, cyan fluorescent protein, yellow fluorescent protein), and/or nucleic acid sequence binding domains (e.g., a DNA binding domain or an RNA binding domain).

A fusion protein can also comprise activator domains (e.g., heat shock transcription factors, NFKB activators) or repressor domains (e.g., a KRAB domain). As described by Lupo, A., et al., Current Genomics 14:268-278 (2013), the KRAB domain is a potent transcriptional repression module and is located in the amino-terminal sequence of most C2H2 zinc finger proteins (see, e.g., Margolin, J., et al., Proc. Natl. Acad. Sci. USA 91:4509-4513 (1994); Witzgall, R., et al., Proc. Natl. Acad. Sci. USA 91:4514-4518 (1994)). The KRAB domain typically binds to co-repressor proteins and/or transcription factors via protein-protein interactions, causing transcriptional repression of genes to which KRAB zinc finger proteins (KRAB-ZFPs) bind (see, e.g., Friedman, J. R., et al., Genes & Development 10:2067-2678 (1996)). In some embodiments, linker nucleic acid sequences are used to join the two or more proteins, protein domains, or protein fragments.

As used herein, "CASCADEa" (Cascade activation) is a CRISPR method or system wherein the method or system activates the expression of a gene associated with the locus of the target nucleic acid sequence of a Cascade RNP complex. In some embodiments, one or more proteins of a Cascade complex are fused to an effector domain (e.g., VP16 or VP64) and a Cascade RNP complex comprising the fusion and guide polynucleotide is used for the recruitment of endogenous transcription factors. In some embodiments, the guide polynucleotide can be fused 5' or 3' to a nucleotide effector domain such as an MS2 binding RNA that also recruits transcription factors.

As used herein, "CASCADEi" (Cascade inhibition) is a CRISPR method or system wherein the CRISPR method or system down-regulates the expression of a gene associated with the locus of the target nucleic acid sequence of a Cascade RNP complex (i.e., a Cascade RNP complex is used down-regulate the expression of the gene). For the recruitment of endogenous repression factors, one or more proteins in a Cascade complex is typically fused to an effector domain (e.g., KRAB). In some embodiments, the guide polynucleotide can be fused 5' or 3' to a nucleotide effector domain that also recruits endogenous transcriptional repression effector proteins.

A "moiety," as used herein, refers to a portion of a molecule. A moiety can be a functional group or describe a portion of a molecule with multiple functional groups (e.g., that share common structural aspects). The terms "moiety" and "functional group" are typically used interchangeably herein; however, a "functional group" can more specifically refer to a portion of a molecule that comprises some common chemical behavior. "Moiety" is often used as a structural description. In some embodiments, a 5' terminus, a 3' terminus, or a 5' terminus and a 3' terminus (e.g., a non-native 5' terminus and/or a non-native 3' terminus in a first stem element) can comprise one or more moieties.

As used herein, "adoptive cell" refers to a cell that can be genetically modified for use in a cell therapy treatment, such for treating cancer and/or preventing graft versus host disease (GvHD) and other undesirable side-effects of cell therapies, such as, but not limited to, cytokine storm, oncogenic transformations of the administered genetically modified material, neurological disorders, and the like. Adoptive cells include, but are not limited to, stem cells, induced pluripotent stem cells (iPSCs), cord blood stem cells, lymphocytes, macrophages, red blood cells, fibroblasts, endothelial cells, epithelial cells, and pancreatic precursor cells.

As used herein, "cell therapy" refers to the treatment of a disease or disorder that utilizes genetically modified cells. Genetic modifications can be introduced using methods described herein, such as methods comprising viral vectors, nucleofection, gene gun delivery, sonoporation, cell squeezing, lipofection, or the use of other chemicals, cell penetrating peptides, and the like.

As used herein, "adoptive cell therapy (ACT)" refers to a therapy that uses genetically modified adoptive cells derived from either a specific patient returned to that patient (autologous cell therapy) or from a third-party donor (allogeneic cell therapy), to treat the patient. ACTs, include, but are not limited to, bone marrow transplants, stem cell transplants, T-cell therapies, CAR-T cell therapies, and natural killer (NK) cell therapies.

As used herein, "lymphocyte" refers to a leukocyte (white blood cell) that is part of the vertebrate immune system. Also encompassed by the term "lymphocyte" is a hematopoietic stem cell or an induced pluripotent stem cells (iPSC) that gives rise to lymphoid cells. Lymphocytes include T cells for cell-mediated, cytotoxic adaptive immunity, such as CD4+ and/or CD8+ cytotoxic T cells; alpha/beta T cells and gamma/delta T cells; regulatory T cells, such as Treg cells; NK cells that function in cell-mediated, cytotoxic innate immunity; B cells, for humoral, antibody-driven adaptive immunity; NK/T cells; cytokine induced killer cells (CIK cells); and antigen presenting cells (APCs), such as dendritic cells. A lymphocyte can be a mammalian cell, such as a human (*Homo sapiens; H. sapiens*) cell. The term "lymphocyte" also encompasses genetically modified T cells and NK cells, modified to produce chimeric antigen receptors (CARs) on the T or NK cell surface (CAR-T cells and CAR-NK cells). These CAR-T cells recognize specific soluble antigens or antigens on a target cell surface, such as a tumor cell surface, or on cells in the tumor microenvironment.

Also encompassed by the term "lymphocyte," as used herein, are T-cell receptor engineered T cells (TCRs), genetically engineered to express one or more specific, naturally occurring or engineered T-cell receptors that can recognize protein or (glyco)lipid antigens of target cells presented by the Major Histocompatibility Complex (MHC). Small pieces of these antigens, such as peptides or fatty acids, are shuttled to the target cell surface and presented to the T-cell receptors as part of the MHC. T-cell receptor binding to antigen-loaded MHCs activates the lymphocyte.

Lymphocyte activation occurs when lymphocytes are triggered through antigen-specific receptors on their cell surface. This causes the cells to proliferate and differentiate into specialized effector lymphocytes. Such "activated" lymphocytes are typically characterized by a set of receptors on the surface of the lymphocyte. Surface markers for activated T cells include CD3, CD4, CD8, PD1, IL2R, and others. Activated cytotoxic lymphocytes can kill target cells after binding cognate receptors on the surface of target cells.

Tumor infiltrating lymphocytes (TILs) are also encompassed by the term "lymphocyte," as used herein. TILs are immune cells that have penetrated the environment in and around a tumor ("the tumor microenvironment"). TILs are typically isolated from tumor cells and the tumor microenvironment and are selected in vitro for high reactivity against tumor antigens. TILs are grown in vitro under conditions that overcome the tolerizing influences that exist in vivo and are then introduced into a subject for treatment.

T cells typically are present in a number of subtypes such as "naive T cells" (Tn), "Stem cell memory T cells" (Tscm), "Central memory T cells" (Tcm) "Effector memory T cells" (Tem), "Effector T cells" (Teff) and "regulatory T cells" (Treg). Each T-cell subset is characterized by a set of cell surface markers.

The term "affinity tag," as used herein, typically refers to one or more moieties that increases the binding affinity of one macromolecule for another, for example, to facilitate formation of an engineered Type I CRISPR-Cas nucleoprotein complex. In some embodiments, an affinity tag can be used to increase the binding affinity of one Cas subunit protein for another Cas subunit protein (e.g., a first Cas7 protein for a second Cas7 protein). In some embodiments, an affinity tag can be used to increase the binding affinity of one or more Cas subunit proteins for a cognate guide polynucleotide. Some embodiments of the present invention introduce one or more affinity tags to the N-terminal of a Cas subunit protein sequence, to the C-terminal of a Cas subunit protein sequence, to a position located between the N-terminal and C-terminal of a Cas subunit protein sequence, or to combinations thereof. In some embodiments of the present invention, one or more guide polynucleotide comprises an affinity tag that increases binding affinity of the guide polynucleotide with one or more Cas subunit proteins. A wide variety of affinity tags are disclosed in U.S. Published Patent Application No. 2014-0315985, published 23 Oct. 2014. Ligands and ligand-binding moieties are paired affinity tags.

As used herein, a "cross-link" is a bond that links one polymer chain (e.g., a polynucleotide or polypeptide) to another. Such bonds can be covalent bonds or ionic bonds. In some embodiments, one polynucleotide can be bound to another polynucleotide by cross linking the polynucleotides. In other embodiments, a polynucleotide can be cross linked to a polypeptide. In additional embodiments, a polypeptide can be cross linked to a polypeptide.

The term "cross-linking moiety," as used herein, typically refers to a moiety suitable to provide cross linking between two macromolecules. A cross-linking moiety is another example of an affinity tag.

As used herein, a "host cell" generally refers to a biological cell. A cell is the basic structural, functional, and/or biological unit of an organism. A cell can originate from any organism having one or more cells. Examples of host cells include, but are not limited to, a prokaryotic cell, eukaryotic cell, a bacterial cell, an archaeal cell, a cell of a single-cell eukaryotic organism, a cell of a eukaryotic organism, a protozoal cell, a cell from a plant, an algal cell, (e.g., *Botryococcus braunii, Chlamydomonas reinhardtii, Nannochloropsis gaditana, Chlorella pyrenoidosa, Sargassum patens C. agardh*, and the like), seaweeds (e.g., kelp), a fungal cell (e.g., a yeast cell or a cell from a mushroom), an animal cell, a cell from an invertebrate animal (e.g., fruit fly, cnidarian, echinoderm, nematode, and the like), a cell from a vertebrate animal including mammals (e.g., a pig, a cow, a goat, a sheep, a rodent, a rat, a mouse, a non-human primate, a human, etc.). Furthermore, a host cell can be a stem cell or progenitor cell, and an immunological cell, such as any of the immunological cells described herein. The host cell can be a human cell. In some embodiments, the human cell is outside of the human body. In some embodiments, cells of a body of a living organism (e.g., a human body) are manipulated ex vivo (i.e., outside of the living body). Ex vivo often refers to a medical procedure in which an organ, cells, or tissue are taken from a living body (e.g., a human body) for a treatment or procedure, and then returned to the living body.

As used herein, "stem cell" refers to a cell that has the capacity for self-renewal, i.e., the ability to go through numerous cycles of cell division while maintaining the undifferentiated state. Stem cells can be totipotent, pluripotent, multipotent, oligopotent, or unipotent. Stem cells can be embryonic, fetal, amniotic, adult, or induced pluripotent stem cells.

As used herein, "induced pluripotent stem cell" refers to a type of pluripotent stem cell that is artificially derived from a non-pluripotent cell, typically a somatic cell. In some embodiments, the somatic cell is a human somatic cell. Examples of somatic cells include, but are not limited to, dermal fibroblasts, bone marrow-derived mesenchymal cells, cardiac muscle cells, keratinocytes, liver cells, stomach cells, neural stem cells, lung cells, kidney cells, spleen cells, and pancreatic cells. Additional examples of somatic cells include cells of the immune system, including but not limited to, B cells, dendritic cells, granulocytes, innate lymphoid cells, megakaryocytes, monocytes/macrophages, myeloid-derived suppressor cells, natural killer (NK) cells, T cells, thymocytes, and hematopoietic stem cells.

As used herein, "hematopoietic stem cell" refers to an undifferentiated cell that has the ability to differentiate into a hematopoietic cell, such as a lymphocyte.

"Plant," as used herein, refers to whole plants, plant organs, plant tissues, germplasm, seeds, plant cells, and progeny of the same. Plant cells include, without limitation, cells from seeds, suspension cultures, embryos, meristematic regions, callus tissue, leaves, roots, shoots, gametophytes, sporophytes, pollen, and microspores. Plant parts include differentiated and undifferentiated tissues including, but not limited to, roots, stems, shoots, leaves, pollens, seeds, tumor tissue, and various forms of cells and culture (e.g., single cells, protoplasts, embryos, and callus tissue). The plant tissue may be in plant or in a plant organ, tissue, or cell culture. "Plant organ" refers to plant tissue or a group of tissues that constitute a morphologically and functionally distinct part of a plant.

The terms "subject," "individual," or "patient" are used interchangeably herein and refer to any member of the phylum Chordate, including, without limitation, humans and other primates, including non-human primates such as rhesus macaques, chimpanzees, and other monkey and ape species; farm animals, such as cattle, sheep, pigs, goats, and horses; domestic mammals, such as dogs and cats; laboratory animals, including rabbits, mice, rats, and guinea pigs; birds, including domestic, wild, and game birds, such as chickens, turkeys, and other gallinaceous birds, ducks, and geese; and the like. The term does not denote a particular age or gender. Thus, the term includes adult, young, and newborn individuals as well as males and females. In some embodiments, a host cell is derived from a subject (for example, lymphocytes, stem cells, progenitor cells, or tissue-specific cells). In some embodiments, the subject is a non-human subject. In some embodiments, the subject is a human (*H. sapiens*) subject.

The terms "effective amount" or "therapeutically effective amount" of a composition or agent, such as a genetically engineered adoptive cell as provided herein, refer to a sufficient amount of the composition or agent to provide the desired response, such as to prevent or eliminate one or more harmful side-effects associated with allogeneic adoptive cell therapies. Such responses will depend on the particular disease in question. For example, in a patient being treated for cancer using an adoptive cell therapy, a desired response includes, but is not limited to, treatment or prevention of the effects of GvHD, Host versus Graft rejection, cytokine release syndrome (CRS), cytokine storm, and the reduction of oncogenic transformations of administered genetically modified cells. The exact amount required will vary from subject to subject, depending on the species, age, and general condition of the subject, the severity of the condition being treated, and the particular modified lymphocyte used, mode of administration, and the like. An appropriate "effective" amount in any individual case may be determined by one of ordinary skill in the art using routine experimentation.

"Treatment" or "treating" a particular disease, such as cancerous condition, or GvHD, includes: (1) preventing the disease, for example, preventing the development of the disease or causing the disease to occur with less intensity in a subject that may be predisposed to the disease but does not yet experience or display symptoms of the disease; (2) inhibiting the disease, for example, reducing the rate of development, arresting the development or reversing the disease state; and/or (3) relieving symptoms of the disease, for example, decreasing the number of symptoms experienced by the subject.

By "gene editing" or "genome editing," as used herein, is meant a type of genetic engineering that results in a genetic modification, such as an insertion, deletion, or replacement of a nucleotide sequence, or even a single base, at a specific site in a cell genome. The terms include, without limitation, heterologous gene expression, gene or promoter insertion or deletion, nucleic acid mutation, and a disruptive genetic modification, as defined herein.

By "epitope" is meant a site on a molecule to which specific B cells and T cells respond. An epitope can comprise 3 or more amino acids in a spatial conformation unique to the epitope. Generally, an epitope consists of at least five such amino acids and, more usually, consists of at least 8-10 such amino acids. Methods of determining spatial conformation of amino acids are known in the art and include, for example, x-ray crystallography, electron microscopy, and 2-dimensional nuclear magnetic resonance. Furthermore, the identification of epitopes in a given protein is readily accomplished using techniques well known in the art, such as by the use of hydrophobicity studies and by site-directed serology.

A "mimotope" is a macromolecule, such as a peptide, that mimics the structure of an epitope. Because of this property, it causes an antibody response similar to the one elicited by the epitope. An antibody for a given epitope antigen will recognize a mimotope that mimics that epitope. Mimotopes are commonly obtained from phage display libraries through biopanning.

An "antibody" intends a molecule that "recognizes," i.e., specifically binds to an epitope of interest present in a polypeptide, such as a ligand binding domain. By "specifically binds" is meant that the antibody interacts with the epitope in a "lock and key" type of interaction to form a complex between the antigen and antibody. The term "antibody," as used herein, includes antibodies obtained from monoclonal preparations, as well as, the following: hybrid (chimeric) antibody molecules; F(ab')2 and F(ab) fragments; Fv molecules (non-covalent heterodimers; single-chain Fv molecules (scFv); dimeric and trimeric antibody fragment constructs; minibodies; humanized antibody molecules; single chain antibodies; Nanobody® (Ablynx N.V., Zwijnaarde, Belgium) antibodies; and any functional fragments obtained from such molecules, wherein such fragments retain immunological binding properties of the parent antibody molecule. The antibodies can be sourced from different species, such as human, mouse, rat, rabbit, camel, chicken, and the like. Antibodies and antibody parts can then be further obtained by in vitro techniques, such as by phage display and yeast display. Fully humanized antibodies can be obtained from human plasma, human B cell cloning, mouse, rat, rabbit, chicken, etc., that have an engineered humanized B cell repertoire. Antibodies can then be further modified by affinity maturation and other methods, such as afucosylation or IgG Fc engineering.

As used herein, the term "monoclonal antibody" refers to an antibody composition having a homogeneous antibody population. The term is not limited regarding the species or source of the antibody, nor is it intended to be limited by the manner in which it is made. The term encompasses whole immunoglobulins as well as fragments such as Fab, $F(ab')_2$, Fv, and other fragments, as well as chimeric and humanized homogeneous antibody populations, that exhibit immunological binding properties of the parent monoclonal antibody molecule.

"Antibody-dependent cell-mediated cytotoxicity (ADCC)" also referred to as "antibody-dependent cellular cytotoxicity," refers to a mechanism whereby an effector cell of the immune system actively lyses a target cell, such as an adoptive cell, when a membrane-surface ligand binding domain has been bound by a specific antibody. Effector cells are typically natural killer (NK) cells. However, macrophages, neutrophils, and eosinophils can also mediate ADCC. ADCC is independent of complement-dependent cytotoxicity (CDC) that also lyses targets by damaging membranes without the involvement of antibodies or cells of the immune system.

"Transformation," as used herein, refers to the insertion of an exogenous polynucleotide into a host cell, irrespective of the method used for insertion. For example, transformation can be by direct uptake, transfection, infection, and the like. The exogenous polynucleotide may be maintained as a nonintegrated vector, for example, an episome, or, alternatively, may be integrated into the host genome. As used herein, "transgenic organism" refers to an organism that contains genetic material into which DNA from an unrelated organism has been artificially introduced. The term includes the progeny (any generation) of a transgenic organism, provided that the progeny has the genetic modification. In some embodiments, the transgenic organism is a non-human transgenic organism.

As used herein, "isolated" can refer to a molecule (e.g., a polynucleotide or a polypeptide) that, by human intervention, exists apart from its native environment and is therefore not a product of nature. When referring to a polypeptide, isolated means that the indicated molecule is separate and discrete from the whole organism with which the molecule is found in nature or is present in the substantial absence of other biological macromolecules of the same type. The term "isolated" with respect to a polynucleotide is a nucleic acid molecule devoid, in whole or part, of sequences normally associated with it in nature; or a sequence, as it exists in nature, but having heterologous sequences in association therewith; or a molecule disassociated from the chromosome.

The term "purified," as used herein, preferably means at least 75% by weight, more preferably at least 85% by weight, more preferably still at least 95% by weight, and most preferably at least 98% by weight, of the same molecule is present.

As used herein, a "substrate channel" refers to the direct transfer of a reactant from one enzymatic reaction to another enzymatic reaction without first diffusing into the bulk environment (see, e.g., Wheeldon, I., et al., Nat. Chem. 8:299-309 (2016)). Intermediates of these enzymatic steps are not in equilibrium with the bulk solution, which enables the increased efficiencies and yields in enzymatic processes. Frequently, enzymes in naturally occurring metabolic processes have evolved means of co-localization and assembly into controlled aggregates.

As used herein, "substrate channel element" refers to a component of a metabolic pathway. In some embodiments, a substrate channel element is an enzyme that catalyzes a chemical reaction.

As used herein, "substrate channel complex" refers to multiple substrate channel elements that are co-localized together via some means.

As used herein, an "RNA scaffold" refers to an RNA molecule that peptides can use as a substrate for binding.

The data presented herein demonstrate that fusions between Cascade components and nuclease domains (e.g., a dimerization-dependent, non-specific FokI nuclease domains; see, e.g., Urnov, F. D., et al., Nature Reviews Genetics 11:636-646 (2010); Joung, J. K., et al., Nat. Rev. Mol. Cell Biol. 14:49-55 (2013); Guilinger, J. P., et al., Nat. Biotechnol. 32:577-582 (2014); Tsai, S. Q., et al., Nat. Biotechnol. 32:569-576 (2014)) mediate efficient programmable RNA-guided gene editing with Type I systems in human cells. The data demonstrate that engineered Type I CRISPR-Cas systems (e.g., a comprising FokI-Cascade component fusion) can be directly transfected as intact ribonucleoprotein (RNP) complexes or assembled in cells via delivery of individual plasmid-encoded components. As set forth herein, all the CRISPR-associated (Cas) genes were assembled onto a single polycistronic vector, yielding a simplified two-component Cas protein-guide RNA expression system. In addition, length/composition design of the nuclease (e.g., FokI)/Cascade component linker sequences and formulation of appropriate DNA geometry, as well as selective Cascade homolog choice, provide engineered Type I CRISPR-Cas complexes having editing efficiencies up to about 50%. Key characteristics of the engineered Type I CRISPR-Cas systems (e.g., comprising FokI-Cascade component fusion proteins) related to PAM requirements and mismatch sensitivities during DNA targeting were determined.

In a first aspect, the present invention relates to engineered polynucleotides encoding Cascade components including, but not limited to, Cascade subunit proteins and Cascade guide polynucleotides.

In one embodiment, the present invention relates to engineered polynucleotides encoding Cascade components that are derived from Cascade Type I-E systems. Exemplary polynucleotide constructs comprising Cascade proteins and Cascade crRNAs are presented in Example 1. Example 1, Table 15, and SEQ ID NO:1 through SEQ ID NO:20 present polynucleotide DNA sequences of genes encoding the five subunit proteins of Type I-E Cascade, specifically from *E. coli* strain K-12 MG1655, as well as the amino acid sequences of the resulting protein components. The polynucleotide sequences were derived from *E. coli* gDNA and were codon-optimized specifically for expression in *E. coli*, and/or codon-optimized specifically for expression in eukaryotic cells (e.g., human cells). When this polynucleotide is transcribed into a precursor crRNA and processed by the Cascade RNA endonuclease, a mature crRNA is produced that functions as a guide RNA to target complementary DNA sequences in the genome. The minimal CRISPR array comprises two repeat sequences (underlined in the CRISPR array sequences presented in Example 1) flanking an exemplary spacer sequence, which represents the guide portion of the crRNA. RNA processing by the Cascade endonuclease generates a crRNA with repeat sequences on both the 5' and 3' ends, flanking the guide sequence. One of ordinary skill in the art, in view of the teachings of the present Specification and the Examples, can select appropriate spacer sequences to target binding of a Cascade complex to a chosen target sequence (e.g., in gDNA).

Polynucleotide sequences encoding Cascade components from additional bacterial or archaeal species can be identified and designed following the guidance of the present Specification and using bioinformatics tools such as BLAST and PSI-BLAST to locate, as an example, homologs of Cascade subunit genes from *E. coli* strain K-12 MG1655, and then inspecting the flanking genomic neighborhood of the Cascade gene to locate and identify genes of the remaining Cascade subunit proteins (see, e.g., Example 14A, Example 14B, Example 15A, and Example 15B). Because Cascade genes co-occur as conserved operons, they are typically arranged in a consistent order, within the same Type I subtype, facilitating their identification and selection for follow-up analysis and experimentation. As an example, additional Type I-E systems can be identified by locating Cas8 homologs, identifying promising bacterial species for homologous Cascade testing, and then obtaining or designing polynucleotide sequences encoding the Cas8 and other protein components of the Cascade from those homologous CRISPR-Cas systems.

Polynucleotide DNA sequences of genes encoding the subunit proteins of Cascade from a number of species (listed in Table 3 and Table 4), some with Cascade complexes homologous to those derived from *E. coli* strain K-12 MG1655, and the amino acid sequences of the resulting protein components, as well as exemplary minimal CRISPR arrays, are presented as SEQ ID NO:22 through SEQ ID NO:213 (Table 3).

TABLE 3

Polynucleotide Sequences for Genes Encoding Cascade Proteins From 12 Species

| SEQ ID NO: | Gene/Protein | Subtype and organism | Type of sequence |
| --- | --- | --- | --- |
| SEQ ID NO: 1 | Cas8 | I-E_*Escherichia coli* K-12 MG1655 | Genomic DNA gene sequence |
| SEQ ID NO: 2 | Cse2 | I-E_*Escherichia coli* K-12 MG1655 | Genomic DNA gene sequence |
| SEQ ID NO: 3 | Cas7 | I-E_*Escherichia coli* K-12 MG1655 | Genomic DNA gene sequence |
| SEQ ID NO: 4 | Cas5 | I-E_*Escherichia coli* K-12 MG1655 | Genomic DNA gene sequence |
| SEQ ID NO: 5 | Cas6 | I-E_*Escherichia coli* K-12 MG1655 | Genomic DNA gene sequence |
| SEQ ID NO: 6 | Cas8 | I-E_*Escherichia coli* K-12 MG1655 | *E. coli* codon-optimized DNA gene sequence |
| SEQ ID NO: 7 | Cse2 | I-E_*Escherichia coli* K-12 MG1655 | *E. coli* codon-optimized DNA gene sequence |
| SEQ ID NO: 8 | Cas7 | I-E_*Escherichia coli* K-12 MG1655 | *E. coli* codon-optimized DNA gene sequence |
| SEQ ID NO: 9 | Cas5 | I-E_*Escherichia coli* K-12 MG1655 | *E. coli* codon-optimized DNA gene sequence |
| SEQ ID NO: 10 | Cas6 | I-E_*Escherichia coli* K-12 MG1655 | *E. coli* codon-optimized DNA gene sequence |
| SEQ ID NO: 11 | Cas8 | I-E_*Escherichia coli* K-12 MG1655 | *H. sapiens* codon-optimized DNA gene sequence |
| SEQ ID NO: 12 | Cse2 | I-E_*Escherichia coli* K-12 MG1655 | *H. sapiens* codon-optimized DNA gene sequence |
| SEQ ID NO: 13 | Cas7 | I-E_*Escherichia coli* K-12 MG1655 | *H. sapiens* codon-optimized DNA gene sequence |
| SEQ ID NO: 14 | Cas5 | I-E_*Escherichia coli* K-12 MG1655 | *H. sapiens* codon-optimized DNA gene sequence |
| SEQ ID NO: 15 | Cas6 | I-E_*Escherichia coli* K-12 MG1655 | *H. sapiens* codon-optimized DNA gene sequence |
| SEQ ID NO: 16 | Cas8 | I-E_*Escherichia coli* K-12 MG1655 | Protein amino acid sequence |
| SEQ ID NO: 17 | Cse2 | I-E_*Escherichia coli* K-12 MG1655 | Protein amino acid sequence |
| SEQ ID NO: 18 | Cas7 | I-E_*Escherichia coli* K-12 MG1655 | Protein amino acid sequence |
| SEQ ID NO: 19 | Cas5 | I-E_*Escherichia coli* K-12 MG1655 | Protein amino acid sequence |
| SEQ ID NO: 20 | Cas6 | I-E_*Escherichia coli* K-12 MG1655 | Protein amino acid sequence |
| SEQ ID NO: 21 | Cas3 | I-E_*Escherichia coli* K-12 MG1655 | Protein amino acid sequence |
| SEQ ID NO: 22 | Cas8 | I-E_*Oceanicola* sp. HL-35 | Genomic DNA gene sequence |
| SEQ ID NO: 23 | Cse2 | I-E_*Oceanicola* sp. HL-35 | Genomic DNA gene sequence |
| SEQ ID NO: 24 | Cas7 | I-E_*Oceanicola* sp. HL-35 | Genomic DNA gene sequence |
| SEQ ID NO: 25 | Cas5 | I-E_*Oceanicola* sp. HL-35 | Genomic DNA gene sequence |
| SEQ ID NO: 26 | Cas6 | I-E_*Oceanicola* sp. HL-35 | Genomic DNA gene sequence |
| SEQ ID NO: 27 | Cas8 | I-E_*Oceanicola* sp. HL-35 | *H. sapiens* codon-optimized DNA gene sequence |
| SEQ ID NO: 28 | Cse2 | I-E_*Oceanicola* sp. HL-35 | *H. sapiens* codon-optimized DNA gene sequence |
| SEQ ID NO: 29 | Cas7 | I-E_*Oceanicola* sp. HL-35 | *H. sapiens* codon-optimized DNA gene sequence |
| SEQ ID NO: 30 | Cas5 | I-E_*Oceanicola* sp. HL-35 | *H. sapiens* codon-optimized DNA gene sequence |
| SEQ ID NO: 31 | Cas6 | I-E_*Oceanicola* sp. HL-35 | *H. sapiens* codon-optimized DNA gene sequence |
| SEQ ID NO: 32 | Cas8 | I-E_*Oceanicola* sp. HL-35 | Protein amino acid sequence |
| SEQ ID NO: 33 | Cse2 | I-E_*Oceanicola* sp. HL-35 | Protein amino acid sequence |
| SEQ ID NO: 34 | Cas7 | I-E_*Oceanicola* sp. HL-35 | Protein amino acid sequence |
| SEQ ID NO: 35 | Cas5 | I-E_*Oceanicola* sp. HL-35 | Protein amino acid sequence |
| SEQ ID NO: 36 | Cas6 | I-E_*Oceanicola* sp. HL-35 | Protein amino acid sequence |
| SEQ ID NO: 37 | CRISPR | I-E_*Oceanicola* sp. HL-35 | Exemplary minimal CRISPR array |
| SEQ ID NO: 38 | Cas8 | I-E_*Pseudomonas* sp. S-6-2 | Genomic DNA gene sequence |
| SEQ ID NO: 39 | Cse2 | I-E_*Pseudomonas* sp. S-6-2 | Genomic DNA gene sequence |
| SEQ ID NO: 40 | Cas7 | I-E_*Pseudomonas* sp. S-6-2 | Genomic DNA gene sequence |
| SEQ ID NO: 41 | Cas5 | I-E_*Pseudomonas* sp. S-6-2 | Genomic DNA gene sequence |
| SEQ ID NO: 42 | Cas6 | I-E_*Pseudomonas* sp. S-6-2 | Genomic DNA gene sequence |
| SEQ ID NO: 43 | Cas8 | I-E_*Pseudomonas* sp. S-6-2 | *H. sapiens* codon-optimized DNA gene sequence |
| SEQ ID NO: 44 | Cse2 | I-E_*Pseudomonas* sp. S-6-2 | *H. sapiens* codon-optimized DNA gene sequence |
| SEQ ID NO: 45 | Cas7 | I-E_*Pseudomonas* sp. S-6-2 | *H. sapiens* codon-optimized DNA gene sequence |

TABLE 3-continued

Polynucleotide Sequences for Genes Encoding Cascade Proteins From 12 Species

| SEQ ID NO: | Gene/Protein | Subtype and organism | Type of sequence |
|---|---|---|---|
| SEQ ID NO: 46 | Cas5 | I-E_*Pseudomonas* sp. S-6-2 | *H. sapiens* codon-optimized DNA gene sequence |
| SEQ ID NO: 47 | Cas6 | I-E_*Pseudomonas* sp. S-6-2 | *H. sapiens* codon-optimized DNA gene sequence |
| SEQ ID NO: 48 | Cas8 | I-E_*Pseudomonas* sp. S-6-2 | Protein amino acid sequence |
| SEQ ID NO: 49 | Cse2 | I-E_*Pseudomonas* sp. S-6-2 | Protein amino acid sequence |
| SEQ ID NO: 50 | Cas7 | I-E_*Pseudomonas* sp. S-6-2 | Protein amino acid sequence |
| SEQ ID NO: 51 | Cas5 | I-E_*Pseudomonas* sp. S-6-2 | Protein amino acid sequence |
| SEQ ID NO: 52 | Cas6 | I-E_*Pseudomonas* sp. S-6-2 | Protein amino acid sequence |
| SEQ ID NO: 53 | CRISPR | I-E_*Pseudomonas* sp. S-6-2 | Exemplary minimal CRISPR array |
| SEQ ID NO: 54 | Cas8 | I-E_*Salmonella enterica* subsp. *enterica* serovar Muenster strain | Genomic DNA gene sequence |
| SEQ ID NO: 55 | Cse2 | I-E_*Salmonella enterica* subsp. *enterica* serovar Muenster strain | Genomic DNA gene sequence |
| SEQ ID NO: 56 | Cas7 | I-E_*Salmonella enterica* subsp. *enterica* serovar Muenster strain | Genomic DNA gene sequence |
| SEQ ID NO: 57 | Cas5 | I-E_*Salmonella enterica* subsp. *enterica* serovar Muenster strain | Genomic DNA gene sequence |
| SEQ ID NO: 58 | Cas6 | I-E_*Salmonella enterica* subsp. *enterica* serovar Muenster strain | Genomic DNA gene sequence |
| SEQ ID NO: 59 | Cas8 | I-E_*Salmonella enterica* subsp. *enterica* serovar Muenster strain | *H. sapiens* codon-optimized DNA gene sequence |
| SEQ ID NO: 60 | Cse2 | I-E_*Salmonella enterica* subsp. *enterica* serovar Muenster strain | *H. sapiens* codon-optimized DNA gene sequence |
| SEQ ID NO: 61 | Cas7 | I-E_*Salmonella enterica* subsp. *enterica* serovar Muenster strain | *H. sapiens* codon-optimized DNA gene sequence |
| SEQ ID NO: 62 | Cas5 | I-E_*Salmonella enterica* subsp. *enterica* serovar Muenster strain | *H. sapiens* codon-optimized DNA gene sequence |
| SEQ ID NO: 63 | Cas6 | I-E_*Salmonella enterica* subsp. *enterica* serovar Muenster strain | *H. sapiens* codon-optimized DNA gene sequence |
| SEQ ID NO: 64 | Cas8 | I-E_*Salmonella enterica* subsp. *enterica* serovar Muenster strain | Protein amino acid sequence |
| SEQ ID NO: 65 | Cse2 | I-E_*Salmonella enterica* subsp. *enterica* serovar Muenster strain | Protein amino acid sequence |
| SEQ ID NO: 66 | Cas7 | I-E_*Salmonella enterica* subsp. *enterica* serovar Muenster strain | Protein amino acid sequence |
| SEQ ID NO: 67 | Cas5 | I-E_*Salmonella enterica* subsp. *enterica* serovar Muenster strain | Protein amino acid sequence |
| SEQ ID NO: 68 | Cas6 | I-E_*Salmonella enterica* subsp. *enterica* serovar Muenster strain | Protein amino acid sequence |
| SEQ ID NO: 69 | CRISPR | I-E_*Salmonella enterica* subsp. *enterica* serovar Muenster strain | Exemplary minimal CRISPR array |
| SEQ ID NO: 70 | Cas8 | I-E_*Atlantibacter hermannii* NBRC 105704 | Genomic DNA gene sequence |
| SEQ ID NO: 71 | Cse2 | I-E_*Atlantibacter hermannii* NBRC 105704 | Genomic DNA gene sequence |
| SEQ ID NO: 72 | Cas7 | I-E_*Atlantibacter hermannii* NBRC 105704 | Genomic DNA gene sequence |
| SEQ ID NO: 73 | Cas5 | I-E_*Atlantibacter hermannii* NBRC 105704 | Genomic DNA gene sequence |
| SEQ ID NO: 74 | Cas6 | I-E_*Atlantibacter hermannii* NBRC 105704 | Genomic DNA gene sequence |
| SEQ ID NO: 75 | Cas8 | I-E_*Atlantibacter hermannii* NBRC 105704 | *H. sapiens* codon-optimized DNA gene sequence |
| SEQ ID NO: 76 | Cse2 | I-E_*Atlantibacter hermannii* NBRC 105704 | *H. sapiens* codon-optimized DNA gene sequence |
| SEQ ID NO: 77 | Cas7 | I-E_*Atlantibacter hermannii* NBRC 105704 | *H. sapiens* codon-optimized DNA gene sequence |
| SEQ ID NO: 78 | Cas5 | I-E_*Atlantibacter hermannii* NBRC 105704 | *H. sapiens* codon-optimized DNA gene sequence |
| SEQ ID NO: 79 | Cas6 | I-E_*Atlantibacter hermannii* NBRC 105704 | *H. sapiens* codon-optimized DNA gene sequence |
| SEQ ID NO: 80 | Cas8 | I-E_*Atlantibacter hermannii* NBRC 105704 | Protein amino acid sequence |
| SEQ ID NO: 81 | Cse2 | I-E_*Atlantibacter hermannii* NBRC 105704 | Protein amino acid sequence |
| SEQ ID NO: 82 | Cas7 | I-E_*Atlantibacter hermannii* NBRC 105704 | Protein amino acid sequence |
| SEQ ID NO: 83 | Cas5 | I-E_*Atlantibacter hermannii* NBRC 105704 | Protein amino acid sequence |
| SEQ ID NO: 84 | Cas6 | I-E_*Atlantibacter hermannii* NBRC 105704 | Protein amino acid sequence |
| SEQ ID NO: 85 | CRISPR | I-E_*Atlantibacter hermannii* NBRC 105704 | Exemplary minimal CRISPR array |
| SEQ ID NO: 86 | Cas8 | I-E_*Geothermobacter* sp. EPR-M | Genomic DNA gene sequence |
| SEQ ID NO: 87 | Cse2 | I-E_*Geothermobacter* sp. EPR-M | Genomic DNA gene sequence |
| SEQ ID NO: 88 | Cas7 | I-E_*Geothermobacter* sp. EPR-M | Genomic DNA gene sequence |
| SEQ ID NO: 89 | Cas5 | I-E_*Geothermobacter* sp. EPR-M | Genomic DNA gene sequence |
| SEQ ID NO: 90 | Cas6 | I-E_*Geothermobacter* sp. EPR-M | Genomic DNA gene sequence |
| SEQ ID NO: 91 | Cas8 | I-E_*Geothermobacter* sp. EPR-M | *H. sapiens* codon-optimized DNA gene sequence |
| SEQ ID NO: 92 | Cse2 | I-E_*Geothermobacter* sp. EPR-M | *H. sapiens* codon-optimized DNA gene sequence |
| SEQ ID NO: 93 | Cas7 | I-E_*Geothermobacter* sp. EPR-M | *H. sapiens* codon-optimized DNA gene sequence |

TABLE 3-continued

Polynucleotide Sequences for Genes Encoding Cascade Proteins From 12 Species

| SEQ ID NO: | Gene/Protein | Subtype and organism | Type of sequence |
|---|---|---|---|
| SEQ ID NO: 94 | Cas5 | I-E_*Geothermobacter* sp. EPR-M | *H. sapiens* codon-optimized DNA gene sequence |
| SEQ ID NO: 95 | Cas6 | I-E_*Geothermobacter* sp. EPR-M | *H. sapiens* codon-optimized DNA gene sequence |
| SEQ ID NO: 96 | Cas8 | I-E_*Geothermobacter* sp. EPR-M | Protein amino acid sequence |
| SEQ ID NO: 97 | Cse2 | I-E_*Geothermobacter* sp. EPR-M | Protein amino acid sequence |
| SEQ ID NO: 98 | Cas7 | I-E_*Geothermobacter* sp. EPR-M | Protein amino acid sequence |
| SEQ ID NO: 99 | Cas5 | I-E_*Geothermobacter* sp. EPR-M | Protein amino acid sequence |
| SEQ ID NO: 100 | Cas6 | I-E_*Geothermobacter* sp. EPR-M | Protein amino acid sequence |
| SEQ ID NO: 101 | CRISPR | I-E_*Geothermobacter* sp. EPR-M | Exemplary minimal CRISPR array |
| SEQ ID NO: 102 | Cas8 | I-E_*Methylocaldum* sp. 14B | Genomic DNA gene sequence |
| SEQ ID NO: 103 | Cse2 | I-E_*Methylocaldum* sp. 14B | Genomic DNA gene sequence |
| SEQ ID NO: 104 | Cas7 | I-E_*Methylocaldum* sp. 14B | Genomic DNA gene sequence |
| SEQ ID NO: 105 | Cas5 | I-E_*Methylocaldum* sp. 14B | Genomic DNA gene sequence |
| SEQ ID NO: 106 | Cas6 | I-E_*Methylocaldum* sp. 14B | Genomic DNA gene sequence |
| SEQ ID NO: 107 | Cas8 | I-E_*Methylocaldum* sp. 14B | *H. sapiens* codon-optimized DNA gene sequence |
| SEQ ID NO: 108 | Cse2 | I-E_*Methylocaldum* sp. 14B | *H. sapiens* codon-optimized DNA gene sequence |
| SEQ ID NO: 109 | Cas7 | I-E_*Methylocaldum* sp. 14B | *H. sapiens* codon-optimized DNA gene sequence |
| SEQ ID NO: 110 | Cas5 | I-E_*Methylocaldum* sp. 14B | *H. sapiens* codon-optimized DNA gene sequence |
| SEQ ID NO: 111 | Cas6 | I-E_*Methylocaldum* sp. 14B | *H. sapiens* codon-optimized DNA gene sequence |
| SEQ ID NO: 112 | Cas8 | I-E_*Methylocaldum* sp. 14B | Protein amino acid sequence |
| SEQ ID NO: 113 | Cse2 | I-E_*Methylocaldum* sp. 14B | Protein amino acid sequence |
| SEQ ID NO: 114 | Cas7 | I-E_*Methylocaldum* sp. 14B | Protein amino acid sequence |
| SEQ ID NO: 115 | Cas5 | I-E_*Methylocaldum* sp. 14B | Protein amino acid sequence |
| SEQ ID NO: 116 | Cas6 | I-E_*Methylocaldum* sp. 14B | Protein amino acid sequence |
| SEQ ID NO: 117 | CRISPR | I-E_*Methylocaldum* sp. 14B | Exemplary minimal CRISPR array |
| SEQ ID NO: 118 | Cas8 | I-E_*Methanocella arvoryzae* MRE50 | Genomic DNA gene sequence |
| SEQ ID NO: 119 | Cse2 | I-E_*Methanocella arvoryzae* MRE50 | Genomic DNA gene sequence |
| SEQ ID NO: 120 | Cas7 | I-E_*Methanocella arvoryzae* MRE50 | Genomic DNA gene sequence |
| SEQ ID NO: 121 | Cas5 | I-E_*Methanocella arvoryzae* MRE50 | Genomic DNA gene sequence |
| SEQ ID NO: 122 | Cas6 | I-E_*Methanocella arvoryzae* MRE50 | Genomic DNA gene sequence |
| SEQ ID NO: 123 | Cas8 | I-E_*Methanocella arvoryzae* MRE50 | *H. sapiens* codon-optimized DNA gene sequence |
| SEQ ID NO: 124 | Cse2 | I-E_*Methanocella arvoryzae* MRE50 | *H. sapiens* codon-optimized DNA gene sequence |
| SEQ ID NO: 125 | Cas7 | I-E_*Methanocella arvoryzae* MRE50 | *H. sapiens* codon-optimized DNA gene sequence |
| SEQ ID NO: 126 | Cas5 | I-E_*Methanocella arvoryzae* MRE50 | *H. sapiens* codon-optimized DNA gene sequence |
| SEQ ID NO: 127 | Cas6 | I-E_*Methanocella arvoryzae* MRE50 | *H. sapiens* codon-optimized DNA gene sequence |
| SEQ ID NO: 128 | Cas8 | I-E_*Methanocella arvoryzae* MRE50 | Protein amino acid sequence |
| SEQ ID NO: 129 | Cse2 | I-E_*Methanocella arvoryzae* MRE50 | Protein amino acid sequence |
| SEQ ID NO: 130 | Cas7 | I-E_*Methanocella arvoryzae* MRE50 | Protein amino acid sequence |
| SEQ ID NO: 131 | Cas5 | I-E_*Methanocella arvoryzae* MRE50 | Protein amino acid sequence |
| SEQ ID NO: 132 | Cas6 | I-E_*Methanocella arvoryzae* MRE50 | Protein amino acid sequence |
| SEQ ID NO: 133 | CRISPR | I-E_*Methanocella arvoryzae* MRE50 | Exemplary minimal CRISPR array |
| SEQ ID NO: 134 | Cas8 | I-E_*Lachnospiraceae bacterium* KH1T2 | Genomic DNA gene sequence |
| SEQ ID NO: 135 | Cse2 | I-E_*Lachnospiraceae bacterium* KH1T2 | Genomic DNA gene sequence |
| SEQ ID NO: 136 | Cas7 | I-E_*Lachnospiraceae bacterium* KH1T2 | Genomic DNA gene sequence |
| SEQ ID NO: 137 | Cas5 | I-E_*Lachnospiraceae bacterium* KH1T2 | Genomic DNA gene sequence |
| SEQ ID NO: 138 | Cas6 | I-E_*Lachnospiraceae bacterium* KH1T2 | Genomic DNA gene sequence |
| SEQ ID NO: 139 | Cas8 | I-E_*Lachnospiraceae bacterium* KH1T2 | *H. sapiens* codon-optimized DNA gene sequence |
| SEQ ID NO: 140 | Cse2 | I-E_*Lachnospiraceae bacterium* KH1T2 | *H. sapiens* codon-optimized DNA gene sequence |
| SEQ ID NO: 141 | Cas7 | I-E_*Lachnospiraceae bacterium* KH1T2 | *H. sapiens* codon-optimized DNA gene sequence |
| SEQ ID NO: 142 | Cas5 | I-E_*Lachnospiraceae bacterium* KH1T2 | *H. sapiens* codon-optimized DNA gene sequence |
| SEQ ID NO: 143 | Cas6 | I-E_*Lachnospiraceae bacterium* KH1T2 | *H. sapiens* codon-optimized DNA gene sequence |
| SEQ ID NO: 144 | Cas8 | I-E_*Lachnospiraceae bacterium* KH1T2 | Protein amino acid sequence |
| SEQ ID NO: 145 | Cse2 | I-E_*Lachnospiraceae bacterium* KH1T2 | Protein amino acid sequence |
| SEQ ID NO: 146 | Cas7 | I-E_*Lachnospiraceae bacterium* KH1T2 | Protein amino acid sequence |
| SEQ ID NO: 147 | Cas5 | I-E_*Lachnospiraceae bacterium* KH1T2 | Protein amino acid sequence |
| SEQ ID NO: 148 | Cas6 | I-E_*Lachnospiraceae bacterium* KH1T2 | Protein amino acid sequence |

TABLE 3-continued

Polynucleotide Sequences for Genes Encoding Cascade Proteins From 12 Species

| SEQ ID NO: | Gene/Protein | Subtype and organism | Type of sequence |
|---|---|---|---|
| SEQ ID NO: 149 | CRISPR | I-E_*Lachnospiraceae bacterium* KH1T2 | Exemplary minimal CRISPR array |
| SEQ ID NO: 150 | Cas8 | I-E_*Klebsiella pneumoniae* strain VRCO0172 | Genomic DNA gene sequence |
| SEQ ID NO: 151 | Cse2 | I-E_*Klebsiella pneumoniae* strain VRCO0172 | Genomic DNA gene sequence |
| SEQ ID NO: 152 | Cas7 | I-E_*Klebsiella pneumoniae* strain VRCO0172 | Genomic DNA gene sequence |
| SEQ ID NO: 153 | Cas5 | I-E_*Klebsiella pneumoniae* strain VRCO0172 | Genomic DNA gene sequence |
| SEQ ID NO: 154 | Cas6 | I-E_*Klebsiella pneumoniae* strain VRCO0172 | Genomic DNA gene sequence |
| SEQ ID NO: 155 | Cas8 | I-E_*Klebsiella pneumoniae* strain VRCO0172 | *H. sapiens* codon-optimized DNA gene sequence |
| SEQ ID NO: 156 | Cse2 | I-E_*Klebsiella pneumoniae* strain VRCO0172 | *H. sapiens* codon-optimized DNA gene sequence |
| SEQ ID NO: 157 | Cas7 | I-E_*Klebsiella pneumoniae* strain VRCO0172 | *H. sapiens* codon-optimized DNA gene sequence |
| SEQ ID NO: 158 | Cas5 | I-E_*Klebsiella pneumoniae* strain VRCO0172 | *H. sapiens* codon-optimized DNA gene sequence |
| SEQ ID NO: 159 | Cas6 | I-E_*Klebsiella pneumoniae* strain VRCO0172 | *H. sapiens* codon-optimized DNA gene sequence |
| SEQ ID NO: 160 | Cas8 | I-E_*Klebsiella pneumoniae* strain VRCO0172 | Protein amino acid sequence |
| SEQ ID NO: 161 | Cse2 | I-E_*Klebsiella pneumoniae* strain VRCO0172 | Protein amino acid sequence |
| SEQ ID NO: 162 | Cas7 | I-E_*Klebsiella pneumoniae* strain VRCO0172 | Protein amino acid sequence |
| SEQ ID NO: 163 | Cas5 | I-E_*Klebsiella pneumoniae* strain VRCO0172 | Protein amino acid sequence |
| SEQ ID NO: 164 | Cas6 | I-E_*Klebsiella pneumoniae* strain VRCO0172 | Protein amino acid sequence |
| SEQ ID NO: 165 | CRISPR | I-E_*Klebsiella pneumoniae* strain VRCO0172 | Exemplary minimal CRISPR array |
| SEQ ID NO: 166 | Cas8 | I-E_*Pseudomonas aeruginosa* DHS01 | Genomic DNA gene sequence |
| SEQ ID NO: 167 | Cse2 | I-E_*Pseudomonas aeruginosa* DHS01 | Genomic DNA gene sequence |
| SEQ ID NO: 168 | Cas7 | I-E_*Pseudomonas aeruginosa* DHS01 | Genomic DNA gene sequence |
| SEQ ID NO: 169 | Cas5 | I-E_*Pseudomonas aeruginosa* DHS01 | Genomic DNA gene sequence |
| SEQ ID NO: 170 | Cas6 | I-E_*Pseudomonas aeruginosa* DHS01 | Genomic DNA gene sequence |
| SEQ ID NO: 171 | Cas8 | I-E_*Pseudomonas aeruginosa* DHS01 | *H. sapiens* codon-optimized DNA gene sequence |
| SEQ ID NO: 172 | Cse2 | I-E_*Pseudomonas aeruginosa* DHS01 | *H. sapiens* codon-optimized DNA gene sequence |
| SEQ ID NO: 173 | Cas7 | I-E_*Pseudomonas aeruginosa* DHS01 | *H. sapiens* codon-optimized DNA gene sequence |
| SEQ ID NO: 174 | Cas5 | I-E_*Pseudomonas aeruginosa* DHS01 | *H. sapiens* codon-optimized DNA gene sequence |
| SEQ ID NO: 175 | Cas6 | I-E_*Pseudomonas aeruginosa* DHS01 | *H. sapiens* codon-optimized DNA gene sequence |
| SEQ ID NO: 176 | Cas8 | I-E_*Pseudomonas aeruginosa* DHS01 | Protein amino acid sequence |
| SEQ ID NO: 177 | Cse2 | I-E_*Pseudomonas aeruginosa* DHS01 | Protein amino acid sequence |
| SEQ ID NO: 178 | Cas7 | I-E_*Pseudomonas aeruginosa* DHS01 | Protein amino acid sequence |
| SEQ ID NO: 179 | Cas5 | I-E_*Pseudomonas aeruginosa* DHS01 | Protein amino acid sequence |
| SEQ ID NO: 180 | Cas6 | I-E_*Pseudomonas aeruginosa* DHS01 | Protein amino acid sequence |
| SEQ ID NO: 181 | CRISPR | I-E_*Pseudomonas aeruginosa* DHS01 | Exemplary minimal CRISPR array |
| SEQ ID NO: 182 | Cas8 | I-E_*Streptococcus thermophilus* strain ND07 | Genomic DNA gene sequence |
| SEQ ID NO: 183 | Cse2 | I-E_*Streptococcus thermophilus* strain ND07 | Genomic DNA gene sequence |
| SEQ ID NO: 184 | Cas7 | I-E_*Streptococcus thermophilus* strain ND07 | Genomic DNA gene sequence |
| SEQ ID NO: 185 | Cas5 | I-E_*Streptococcus thermophilus* strain ND07 | Genomic DNA gene sequence |
| SEQ ID NO: 186 | Cas6 | I-E_*Streptococcus thermophilus* strain ND07 | Genomic DNA gene sequence |
| SEQ ID NO: 187 | Cas8 | I-E_*Streptococcus thermophilus* strain ND07 | *H. sapiens* codon-optimized DNA gene sequence |
| SEQ ID NO: 188 | Cse2 | I-E_*Streptococcus thermophilus* strain ND07 | *H. sapiens* codon-optimized DNA gene sequence |
| SEQ ID NO: 189 | Cas7 | I-E_*Streptococcus thermophilus* strain ND07 | *H. sapiens* codon-optimized DNA gene sequence |
| SEQ ID NO: 190 | Cas5 | I-E_*Streptococcus thermophilus* strain ND07 | *H. sapiens* codon-optimized DNA gene sequence |
| SEQ ID NO: 191 | Cas6 | I-E_*Streptococcus thermophilus* strain ND07 | *H. sapiens* codon-optimized DNA gene sequence |

TABLE 3-continued

Polynucleotide Sequences for Genes Encoding Cascade Proteins From 12 Species

| SEQ ID NO: | Gene/Protein | Subtype and organism | Type of sequence |
| --- | --- | --- | --- |
| SEQ ID NO: 192 | Cas8 | I-E_*Streptococcus thermophilus* strain ND07 | Protein amino acid sequence |
| SEQ ID NO: 193 | Cse2 | I-E_*Streptococcus thermophilus* strain ND07 | Protein amino acid sequence |
| SEQ ID NO: 194 | Cas7 | I-E_*Streptococcus thermophilus* strain ND07 | Protein amino acid sequence |
| SEQ ID NO: 195 | Cas5 | I-E_*Streptococcus thermophilus* strain ND07 | Protein amino acid sequence |
| SEQ ID NO: 196 | Cas6 | I-E_*Streptococcus thermophilus* strain ND07 | Protein amino acid sequence |
| SEQ ID NO: 197 | CRISPR | I-E_*Streptococcus thermophilus* strain ND07 | Exemplary minimal CRISPR array |
| SEQ ID NO: 198 | Cas8 | I-E_*Streptomyces* sp. S4 | Genomic DNA gene sequence |
| SEQ ID NO: 199 | Cse2 | I-E_*Streptomyces* sp. S4 | Genomic DNA gene sequence |
| SEQ ID NO: 200 | Cas7 | I-E_*Streptomyces* sp. S4 | Genomic DNA gene sequence |
| SEQ ID NO: 201 | Cas5 | I-E_*Streptomyces* sp. S4 | Genomic DNA gene sequence |
| SEQ ID NO: 202 | Cas6 | I-E_*Streptomyces* sp. S4 | Genomic DNA gene sequence |
| SEQ ID NO: 203 | Cas8 | I-E_*Streptomyces* sp. S4 | *H. sapiens* codon-optimized DNA gene sequence |
| SEQ ID NO: 204 | Cse2 | I-E_*Streptomyces* sp. S4 | *H. sapiens* codon-optimized DNA gene sequence |
| SEQ ID NO: 205 | Cas7 | I-E_*Streptomyces* sp. S4 | *H. sapiens* codon-optimized DNA gene sequence |
| SEQ ID NO: 206 | Cas5 | I-E_*Streptomyces* sp. S4 | *H. sapiens* codon-optimized DNA gene sequence |
| SEQ ID NO: 207 | Cas6 | I-E_*Streptomyces* sp. S4 | *H. sapiens* codon-optimized DNA gene sequence |
| SEQ ID NO: 208 | Cas8 | I-E_*Streptomyces* sp. S4 | Protein amino acid sequence |
| SEQ ID NO: 209 | Cse2 | I-E_*Streptomyces* sp. S4 | Protein amino acid sequence |
| SEQ ID NO: 210 | Cas7 | I-E_*Streptomyces* sp. S4 | Protein amino acid sequence |
| SEQ ID NO: 211 | Cas5 | I-E_*Streptomyces* sp. S4 | Protein amino acid sequence |
| SEQ ID NO: 212 | Cas6 | I-E_*Streptomyces* sp. S4 | Protein amino acid sequence |
| SEQ ID NO: 213 | CRISPR | I-E_*Streptomyces* sp. S4 | Exemplary minimal CRISPR array |
| SEQ ID NO: 214 | Cas6 | I-B_*Fusobacterium nucleatum* subsp. *animalis* 3_1_33 | Genomic DNA gene sequence |
| SEQ ID NO: 215 | Cas8 | I-B_*Fusobacterium nucleatum* subsp. *animalis* 3_1_33 | Genomic DNA gene sequence |
| SEQ ID NO: 216 | Cas7 | I-B_*Fusobacterium nucleatum* subsp. *animalis* 3_1_33 | Genomic DNA gene sequence |
| SEQ ID NO: 217 | Cas5 | I-B_*Fusobacterium nucleatum* subsp. *animalis* 3_1_33 | Genomic DNA gene sequence |
| SEQ ID NO: 218 | Cas6 | I-B_*Fusobacterium nucleatum* subsp. *animalis* 3_1_33 | *H. sapiens* codon-optimized DNA gene sequence |
| SEQ ID NO: 219 | Cas8 | I-B_*Fusobacterium nucleatum* subsp. *animalis* 3_1_33 | *H. sapiens* codon-optimized DNA gene sequence |
| SEQ ID NO: 220 | Cas7 | I-B_*Fusobacterium nucleatum* subsp. *animalis* 3_1_33 | *H. sapiens* codon-optimized DNA gene sequence |
| SEQ ID NO: 221 | Cas5 | I-B_*Fusobacterium nucleatum* subsp. *animalis* 3_1_33 | *H. sapiens* codon-optimized DNA gene sequence |
| SEQ ID NO: 222 | Cas6 | I-B_*Fusobacterium nucleatum* subsp. *animalis* 3_1_33 | Protein amino acid sequence |
| SEQ ID NO: 223 | Cas8 | I-B_*Fusobacterium nucleatum* subsp. *animalis* 3_1_33 | Protein amino acid sequence |
| SEQ ID NO: 224 | Cas7 | I-B_*Fusobacterium nucleatum* subsp. *animalis* 3_1_33 | Protein amino acid sequence |
| SEQ ID NO: 225 | Cas5 | I-B_*Fusobacterium nucleatum* subsp. *animalis* 3_1_33 | Protein amino acid sequence |
| SEQ ID NO: 226 | CRISPR | I-B_*Fusobacterium nucleatum* subsp. *animalis* 3_1_33 | Exemplary minimal CRISPR array |
| SEQ ID NO: 227 | Cas6 | I-B_*Campylobacter fetus* subsp. *testudinum* Sp3 | Genomic DNA gene sequence |
| SEQ ID NO: 228 | Cas8 | I-B_*Campylobacter fetus* subsp. *testudinum* Sp3 | Genomic DNA gene sequence |
| SEQ ID NO: 229 | Cas7 | I-B_*Campylobacter fetus* subsp. *testudinum* Sp3 | Genomic DNA gene sequence |
| SEQ ID NO: 230 | Cas5 | I-B_*Campylobacter fetus* subsp. *testudinum* Sp3 | Genomic DNA gene sequence |
| SEQ ID NO: 231 | Cas6 | I-B_*Campylobacter fetus* subsp. *testudinum* Sp3 | *H. sapiens* codon-optimized DNA gene sequence |
| SEQ ID NO: 232 | Cas8 | I-B_*Campylobacter fetus* subsp. *testudinum* Sp3 | *H. sapiens* codon-optimized DNA gene sequence |
| SEQ ID NO: 233 | Cas7 | I-B_*Campylobacter fetus* subsp. *testudinum* Sp3 | *H. sapiens* codon-optimized DNA gene sequence |
| SEQ ID NO: 234 | Cas5 | I-B_*Campylobacter fetus* subsp. *testudinum* Sp3 | *H. sapiens* codon-optimized DNA gene sequence |

TABLE 3-continued

Polynucleotide Sequences for Genes Encoding Cascade Proteins From 12 Species

| SEQ ID NO: | Gene/Protein | Subtype and organism | Type of sequence |
|---|---|---|---|
| SEQ ID NO: 235 | Cas6 | I-B_*Campylobacter fetus* subsp. *testudinum* Sp3 | Protein amino acid sequence |
| SEQ ID NO: 236 | Cas8 | I-B_*Campylobacter fetus* subsp. *testudinum* Sp3 | Protein amino acid sequence |
| SEQ ID NO: 237 | Cas7 | I-B_*Campylobacter fetus* subsp. *testudinum* Sp3 | Protein amino acid sequence |
| SEQ ID NO: 238 | Cas5 | I-B_*Campylobacter fetus* subsp. *testudinum* Sp3 | Protein amino acid sequence |
| SEQ ID NO: 239 | CRISPR | I-B_*Campylobacter fetus* subsp. *testudinum* Sp3 | Exemplary minimal CRISPR array |
| SEQ ID NO: 240 | Cas6 | I-B_*Odoribacter splanchnicus* DSM 20712 | Genomic DNA gene sequence |
| SEQ ID NO: 241 | Cas8 | I-B_*Odoribacter splanchnicus* DSM 20712 | Genomic DNA gene sequence |
| SEQ ID NO: 242 | Cas7 | I-B_*Odoribacter splanchnicus* DSM 20712 | Genomic DNA gene sequence |
| SEQ ID NO: 243 | Cas5 | I-B_*Odoribacter splanchnicus* DSM 20712 | Genomic DNA gene sequence |
| SEQ ID NO: 244 | Cas6 | I-B_*Odoribacter splanchnicus* DSM 20712 | *H. sapiens* codon-optimized DNA gene sequence |
| SEQ ID NO: 245 | Cas8 | I-B_*Odoribacter splanchnicus* DSM 20712 | *H. sapiens* codon-optimized DNA gene sequence |
| SEQ ID NO: 246 | Cas7 | I-B_*Odoribacter splanchnicus* DSM 20712 | *H. sapiens* codon-optimized DNA gene sequence |
| SEQ ID NO: 247 | Cas5 | I-B_*Odoribacter splanchnicus* DSM 20712 | *H. sapiens* codon-optimized DNA gene sequence |
| SEQ ID NO: 248 | Cas6 | I-B_*Odoribacter splanchnicus* DSM 20712 | Protein amino acid sequence |
| SEQ ID NO: 249 | Cas8 | I-B_*Odoribacter splanchnicus* DSM 20712 | Protein amino acid sequence |
| SEQ ID NO: 250 | Cas7 | I-B_*Odoribacter splanchnicus* DSM 20712 | Protein amino acid sequence |
| SEQ ID NO: 251 | Cas5 | I-B_*Odoribacter splanchnicus* DSM 20712 | Protein amino acid sequence |
| SEQ ID NO: 252 | CRISPR | I-B_*Odoribacter splanchnicus* DSM 20712 | Exemplary minimal CRISPR array |
| SEQ ID NO: 253 | Cas5 | I-C_*Bacillus halodurans* C-125 | Genomic DNA gene sequence |
| SEQ ID NO: 254 | Cas8 | I-C_*Bacillus halodurans* C-125 | Genomic DNA gene sequence |
| SEQ ID NO: 255 | Cas7 | I-C_*Bacillus halodurans* C-125 | Genomic DNA gene sequence |
| SEQ ID NO: 256 | Cas5 | I-C_*Bacillus halodurans* C-125 | *H. sapiens* codon-optimized DNA gene sequence |
| SEQ ID NO: 257 | Cas8 | I-C_*Bacillus halodurans* C-125 | *H. sapiens* codon-optimized DNA gene sequence |
| SEQ ID NO: 258 | Cas7 | I-C_*Bacillus halodurans* C-125 | *H. sapiens* codon-optimized DNA gene sequence |
| SEQ ID NO: 259 | Cas5 | I-C_*Bacillus halodurans* C-125 | Protein amino acid sequence |
| SEQ ID NO: 260 | Cas8 | I-C_*Bacillus halodurans* C-125 | Protein amino acid sequence |
| SEQ ID NO: 261 | Cas7 | I-C_*Bacillus halodurans* C-125 | Protein amino acid sequence |
| SEQ ID NO: 262 | CRISPR | I-C_*Bacillus halodurans* C-125 | Exemplary minimal CRISPR array |
| SEQ ID NO: 263 | Cas5 | I-C_*Desulfovibrio vulgaris* RCH1 plasmid pDEVAL01 | Genomic DNA gene sequence |
| SEQ ID NO: 264 | Cas8 | I-C_*Desulfovibrio vulgaris* RCH1 plasmid pDEVAL01 | Genomic DNA gene sequence |
| SEQ ID NO: 265 | Cas7 | I-C_*Desulfovibrio vulgaris* RCH1 plasmid pDEVAL01 | Genomic DNA gene sequence |
| SEQ ID NO: 266 | Cas5 | I-C_*Desulfovibrio vulgaris* RCH1 plasmid pDEVAL01 | *H. sapiens* codon-optimized DNA gene sequence |
| SEQ ID NO: 267 | Cas8 | I-C_*Desulfovibrio vulgaris* RCH1 plasmid pDEVAL01 | *H. sapiens* codon-optimized DNA gene sequence |
| SEQ ID NO: 268 | Cas7 | I-C_*Desulfovibrio vulgaris* RCH1 plasmid pDEVAL01 | *H. sapiens* codon-optimized DNA gene sequence |
| SEQ ID NO: 269 | Cas5 | I-C_*Desulfovibrio vulgaris* RCH1 plasmid pDEVAL01 | Protein amino acid sequence |
| SEQ ID NO: 270 | Cas8 | I-C_*Desulfovibrio vulgaris* RCH1 plasmid pDEVAL01 | Protein amino acid sequence |
| SEQ ID NO: 271 | Cas7 | I-C_*Desulfovibrio vulgaris* RCH1 plasmid pDEVAL01 | Protein amino acid sequence |
| SEQ ID NO: 272 | CRISPR | I-C_*Desulfovibrio vulgaris* RCH1 plasmid pDEVAL01 | Exemplary minimal CRISPR array |
| SEQ ID NO: 273 | Cas5 | I-C_*Geobacillus thermocatenulatus* strain KCTC 3921 | Genomic DNA gene sequence |
| SEQ ID NO: 274 | Cas8 | I-C_*Geobacillus thermocatenulatus* strain KCTC 3921 | Genomic DNA gene sequence |
| SEQ ID NO: 275 | Cas7 | I-C_*Geobacillus thermocatenulatus* strain KCTC 3921 | Genomic DNA gene sequence |
| SEQ ID NO: 276 | Cas5 | I-C_*Geobacillus thermocatenulatus* strain KCTC 3921 | *H. sapiens* codon-optimized DNA gene sequence |
| SEQ ID NO: 277 | Cas8 | I-C_*Geobacillus thermocatenulatus* strain KCTC 3921 | *H. sapiens* codon-optimized DNA gene sequence |
| SEQ ID NO: 278 | Cas7 | I-C_*Geobacillus thermocatenulatus* strain KCTC 3921 | *H. sapiens* codon-optimized DNA gene sequence |
| SEQ ID NO: 279 | Cas5 | I-C_*Geobacillus thermocatenulatus* strain KCTC 3921 | Protein amino acid sequence |

TABLE 3-continued

Polynucleotide Sequences for Genes Encoding Cascade Proteins From 12 Species

| SEQ ID NO: | Gene/Protein | Subtype and organism | Type of sequence |
|---|---|---|---|
| SEQ ID NO: 280 | Cas8 | I-C_*Geobacillus thermocatenulatus* strain KCTC 3921 | Protein amino acid sequence |
| SEQ ID NO: 281 | Cas7 | I-C_*Geobacillus thermocatenulatus* strain KCTC 3921 | Protein amino acid sequence |
| SEQ ID NO: 282 | CRISPR | I-C_*Geobacillus thermocatenulatus* strain KCTC 3921 | Exemplary minimal CRISPR array |
| SEQ ID NO: 283 | Cas8 | I-F_*Vibrio cholerae* strain L15 | Genomic DNA gene sequence |
| SEQ ID NO: 284 | Cas5 | I-F_*Vibrio cholerae* strain L15 | Genomic DNA gene sequence |
| SEQ ID NO: 285 | Cas7 | I-F_*Vibrio cholerae* strain L15 | Genomic DNA gene sequence |
| SEQ ID NO: 286 | Cas6 | I-F_*Vibrio cholerae* strain L15 | Genomic DNA gene sequence |
| SEQ ID NO: 287 | Cas8 | I-F_*Vibrio cholerae* strain L15 | *H. sapiens* codon-optimized DNA gene sequence |
| SEQ ID NO: 288 | Cas5 | I-F_*Vibrio cholerae* strain L15 | *H. sapiens* codon-optimized DNA gene sequence |
| SEQ ID NO: 289 | Cas7 | I-F_*Vibrio cholerae* strain L15 | *H. sapiens* codon-optimized DNA gene sequence |
| SEQ ID NO: 290 | Cas6 | I-F_*Vibrio cholerae* strain L15 | *H. sapiens* codon-optimized DNA gene sequence |
| SEQ ID NO: 291 | Cas8 | I-F_*Vibrio cholerae* strain L15 | Protein amino acid sequence |
| SEQ ID NO: 292 | Cas5 | I-F_*Vibrio cholerae* strain L15 | Protein amino acid sequence |
| SEQ ID NO: 293 | Cas7 | I-F_*Vibrio cholerae* strain L15 | Protein amino acid sequence |
| SEQ ID NO: 294 | Cas6 | I-F_*Vibrio cholerae* strain L15 | Protein amino acid sequence |
| SEQ ID NO: 295 | CRISPR | I-F_*Vibrio cholerae* strain L15 | Exemplary minimal CRISPR array |
| SEQ ID NO: 296 | Cas8 | I-F_*Klebsiella oxytoca* strain ICU1-2b | Genomic DNA gene sequence |
| SEQ ID NO: 297 | Cas5 | I-F_*Klebsiella oxytoca* strain ICU1-2b | Genomic DNA gene sequence |
| SEQ ID NO: 298 | Cas7 | I-F_*Klebsiella oxytoca* strain ICU1-2b | Genomic DNA gene sequence |
| SEQ ID NO: 299 | Cas6 | I-F_*Klebsiella oxytoca* strain ICU1-2b | Genomic DNA gene sequence |
| SEQ ID NO: 300 | Cas8 | I-F_*Klebsiella oxytoca* strain ICU1-2b | *H. sapiens* codon-optimized DNA gene sequence |
| SEQ ID NO: 301 | Cas5 | I-F_*Klebsiella oxytoca* strain ICU1-2b | *H. sapiens* codon-optimized DNA gene sequence |
| SEQ ID NO: 302 | Cas7 | I-F_*Klebsiella oxytoca* strain ICU1-2b | *H. sapiens* codon-optimized DNA gene sequence |
| SEQ ID NO: 303 | Cas6 | I-F_*Klebsiella oxytoca* strain ICU1-2b | *H. sapiens* codon-optimized DNA gene sequence |
| SEQ ID NO: 304 | Cas8 | I-F_*Klebsiella oxytoca* strain ICU1-2b | Protein amino acid sequence |
| SEQ ID NO: 305 | Cas5 | I-F_*Klebsiella oxytoca* strain ICU1-2b | Protein amino acid sequence |
| SEQ ID NO: 306 | Cas7 | I-F_*Klebsiella oxytoca* strain ICU1-2b | Protein amino acid sequence |
| SEQ ID NO: 307 | Cas6 | I-F_*Klebsiella oxytoca* strain ICU1-2b | Protein amino acid sequence |
| SEQ ID NO: 308 | CRISPR | I-F_*Klebsiella oxytoca* strain ICU1-2b | Exemplary minimal CRISPR array |
| SEQ ID NO: 309 | Cas8 | I-F_*Pseudomonas aeruginosa* UCBPP-PA14 | Genomic DNA gene sequence |
| SEQ ID NO: 310 | Cas5 | I-F_*Pseudomonas aeruginosa* UCBPP-PA14 | Genomic DNA gene sequence |
| SEQ ID NO: 311 | Cas7 | I-F_*Pseudomonas aeruginosa* UCBPP-PA14 | Genomic DNA gene sequence |
| SEQ ID NO: 312 | Cas6 | I-F_*Pseudomonas aeruginosa* UCBPP-PA14 | Genomic DNA gene sequence |
| SEQ ID NO: 313 | Cas8 | I-F_*Pseudomonas aeruginosa* UCBPP-PA14 | *H. sapiens* codon-optimized DNA gene sequence |
| SEQ ID NO: 314 | Cas5 | I-F_*Pseudomonas aeruginosa* UCBPP-PA14 | *H. sapiens* codon-optimized DNA gene sequence |
| SEQ ID NO: 315 | Cas7 | I-F_*Pseudomonas aeruginosa* UCBPP-PA14 | *H. sapiens* codon-optimized DNA gene sequence |
| SEQ ID NO: 316 | Cas6 | I-F_*Pseudomonas aeruginosa* UCBPP-PA14 | *H. sapiens* codon-optimized DNA gene sequence |
| SEQ ID NO: 317 | Cas8 | I-F_*Pseudomonas aeruginosa* UCBPP-PA14 | Protein amino acid sequence |
| SEQ ID NO: 318 | Cas5 | I-F_*Pseudomonas aeruginosa* UCBPP-PA14 | Protein amino acid sequence |
| SEQ ID NO: 319 | Cas7 | I-F_*Pseudomonas aeruginosa* UCBPP-PA14 | Protein amino acid sequence |
| SEQ ID NO: 320 | Cas6 | I-F_*Pseudomonas aeruginosa* UCBPP-PA14 | Protein amino acid sequence |
| SEQ ID NO: 321 | CRISPR | I-F_*Pseudomonas aeruginosa* UCBPP-PA14 | Exemplary minimal CRISPR array |
| SEQ ID NO: 322 | Cas7 | I-Fv2_*Shewanella putrefaciens* CN-32 | Genomic DNA gene sequence |
| SEQ ID NO: 323 | Cas5 | I-Fv2_*Shewanella putrefaciens* CN-32 | Genomic DNA gene sequence |
| SEQ ID NO: 324 | Cas6 | I-Fv2_*Shewanella putrefaciens* CN-32 | Genomic DNA gene sequence |
| SEQ ID NO: 325 | Cas7 | I-Fv2_*Shewanella putrefaciens* CN-32 | *H. sapiens* codon-optimized DNA gene sequence |
| SEQ ID NO: 326 | Cas5 | I-Fv2_*Shewanella putrefaciens* CN-32 | *H. sapiens* codon-optimized DNA gene sequence |
| SEQ ID NO: 327 | Cas6 | I-Fv2_*Shewanella putrefaciens* CN-32 | *H. sapiens* codon-optimized DNA gene sequence |
| SEQ ID NO: 328 | Cas7 | I-Fv2_*Shewanella putrefaciens* CN-32 | Protein amino acid sequence |
| SEQ ID NO: 329 | Cas5 | I-Fv2_*Shewanella putrefaciens* CN-32 | Protein amino acid sequence |
| SEQ ID NO: 330 | Cas6 | I-Fv2_*Shewanella putrefaciens* CN-32 | Protein amino acid sequence |
| SEQ ID NO: 331 | CRISPR | I-Fv2_*Shewanella putrefaciens* CN-32 | Exemplary minimal CRISPR array |
| SEQ ID NO: 332 | Cas7 | I-Fv2_*Acinetobacter* sp. 869535 | Genomic DNA gene sequence |
| SEQ ID NO: 333 | Cas5 | I-Fv2_*Acinetobacter* sp. 869535 | Genomic DNA gene sequence |

TABLE 3-continued

Polynucleotide Sequences for Genes Encoding Cascade Proteins From 12 Species

| SEQ ID NO: | Gene/Protein | Subtype and organism | Type of sequence |
|---|---|---|---|
| SEQ ID NO: 334 | Cas6 | I-Fv2_*Acinetobacter* sp. 869535 | Genomic DNA gene sequence |
| SEQ ID NO: 335 | Cas7 | I-Fv2_*Acinetobacter* sp. 869535 | *H. sapiens* codon-optimized DNA gene sequence |
| SEQ ID NO: 336 | Cas5 | I-Fv2_*Acinetobacter* sp. 869535 | *H. sapiens* codon-optimized DNA gene sequence |
| SEQ ID NO: 337 | Cas6 | I-Fv2_*Acinetobacter* sp. 869535 | *H. sapiens* codon-optimized DNA gene sequence |
| SEQ ID NO: 338 | Cas7 | I-Fv2_*Acinetobacter* sp. 869535 | Protein amino acid sequence |
| SEQ ID NO: 339 | Cas5 | I-Fv2_*Acinetobacter* sp. 869535 | Protein amino acid sequence |
| SEQ ID NO: 340 | Cas6 | I-Fv2_*Acinetobacter* sp. 869535 | Protein amino acid sequence |
| SEQ ID NO: 341 | CRISPR | I-Fv2_*Acinetobacter* sp. 869535 | Exemplary minimal CRISPR array |
| SEQ ID NO: 342 | Cas7 | I-Fv2_*Vibrio cholerae* HE48 | Genomic DNA gene sequence |
| SEQ ID NO: 343 | Cas5 | I-Fv2_*Vibrio cholerae* HE48 | Genomic DNA gene sequence |
| SEQ ID NO: 344 | Cas6 | I-Fv2_*Vibrio cholerae* HE48 | Genomic DNA gene sequence |
| SEQ ID NO: 345 | Cas7 | I-Fv2_*Vibrio cholerae* HE48 | *H. sapiens* codon-optimized DNA gene sequence |
| SEQ ID NO: 346 | Cas5 | I-Fv2_*Vibrio cholerae* HE48 | *H. sapiens* codon-optimized DNA gene sequence |
| SEQ ID NO: 347 | Cas6 | I-Fv2_*Vibrio cholerae* HE48 | *H. sapiens* codon-optimized DNA gene sequence |
| SEQ ID NO: 348 | Cas7 | I-Fv2_*Vibrio cholerae* HE48 | Protein amino acid sequence |
| SEQ ID NO: 349 | Cas5 | I-Fv2_*Vibrio cholerae* HE48 | Protein amino acid sequence |
| SEQ ID NO: 350 | Cas6 | I-Fv2_*Vibrio cholerae* HE48 | Protein amino acid sequence |
| SEQ ID NO: 351 | CRISPR | I-Fv2_*Vibrio cholerae* HE48 | Exemplary minimal CRISPR array |

The polynucleotide sequences for the proteins were derived from the gDNA of the host bacterium, and were codon-optimized specifically for expression in *E. coli*, and/or codon-optimized specifically for expression in eukaryotic cells (e.g., human cells). The polynucleotide DNA sequences encoding corresponding minimal CRISPR arrays were based on repeat sequences derived from the 12 species and can be used to generate mature crRNA that function as guide RNAs. In Table 4, the minimal CRISPR array comprises two repeat sequences (lower case, underlined) flanking an exemplary "spacer" sequence, which represents the guide portion of the crRNA. RNA processing by the endonuclease Cascade subunit generates a crRNA with repeat sequences on both the 5' and 3' ends, flanking the guide sequence.

TABLE 4

Minimal CRISPR Arrays

| SEQ ID NO: | Species | Minimal CRISPR repeat |
|---|---|---|
| SEQ ID NO: 37 | I-E_*Oceanicola* sp. HL-35 | ctgttccccgcacacgcggggatgaaccgGGTTCT TCGATCTGCGCATCCATGATGCCGC Cctgttccccgcacacgcggggatgaaccg |
| SEQ ID NO: 53 | I-E_*Pseudomonas* sp. S-6-2 | gtgttccccgcacctgcggggatgaaccGGGCCG GGGCGTTTGCGCTGTCAGGGCGT CCCgtgttccccgcacctgcggggatgaaccg |
| SEQ ID NO: 69 | I-E_*Salmonella enterica* subsp. *enterica* serovar Muenster strain | gtgttccccgcgccagcggggataaaccgCAGCTT TAGCATCGGTCGACAGCCCATCTG GCgtgttccccgcgccagcggggataaaccg |
| SEQ ID NO: 85 | I-E_*Atlantibacter hermannii* NBRC 105704 | gtgttccccgcgccagcggggataaaccgTTTTAA AACAGGATGTGGCCCGCCTGGTGC TGgtgttccccgcgccagcggggataaaccg |
| SEQ ID NO: 101 | I-E_*Geothermobacter* sp. EPR-M | ctgttccccgcaccCgcggggatgaaccgGTCATC TATTTTTAATGGACGATATTTTCA Actgttccccgcaccgcggggatgaaccg |
| SEQ ID NO: 117 | I-E_*Methylocaldum* sp. 14B | ctgttccccacgtacgtggggatgaaccgACGGCG TAATGGTAATTGTTAGCCGACAAG TTctgttccccacgtacgtggggatgaaccg |
| SEQ ID NO: 133 | I-E_*Methanocella arvoryzae* MRE50 | aaagtccccacaggcgtgggggtgaaccgTGATC AGTAACCCGGTCACCATTAAACAG ATTaaagtccccacaggcgtgggggtgaaccg |

TABLE 4-continued

Minimal CRISPR Arrays

| SEQ ID NO: | Species | Minimal CRISPR repeat |
|---|---|---|
| SEQ ID NO: 149 | I-E_Lachnospiraceae bacterium KH1T2 | gtattccccacgcacgtggrggtaaatcCGCTGAG TTTAATTACGCAGCGGAAGCCGGA GCGgtattccccacgcacgtgggggtaaatc |
| SEQ ID NO: 165 | I-E_Klebsiella pneumoniae strain VRC00172 | gtatccccacacgcgtgggggtgtttcCGGCTCTT TTTTATCTCCTTCATCCTTCGCTATgt cttccccacacgcgtgggggtgtttc |
| SEQ ID NO: 181 | I-E_Pseudomonas aeruginosa DHS01 | gtgttccccacatgcgtggggatgaaccgGGCACC ATCGGCGCCATTGACCGCGCGCTG AAGgtgttccccacatgcgtggggatgaaccg |
| SEQ ID NO: 197 | I-E_Streptococcus thermophilus strain ND07 | gtttttcccgcacacgcgggggtgatccTATACCT ATATCAATGGCCTCCCACGCATAA GCgtttttcccgcacacgcgggggtgatcc |
| SEQ ID NO: 213 | I-E_Streptomyces sp. S4 | gtcggccccgcacccgcggggatgctccAATGGC CGAGGACGACGGCGATCTGGCCAC GGACgtcggccccgcacccgcggggatgctcc |

In another embodiment, the present invention relates to engineered polynucleotide sequences encoding Cascade components from additional bacterial or archaeal species, within other Type I subtypes; including, but not limited, to Types I-B, I-C, I-F, and variants of I-F, which can be identified and designed following the guidance of the present Specification and by using bioinformatics tools such as BLAST and PSI-BLAST to locate homologs of Cascade genes from hallmark systems typifying each subtype (see, e.g., Makarova, K. S., et al., Nat. Rev. Microbiol. 13:722-736 (2015); Koonin, E. V., et al., Curr. Opin. Microbiol. 37:67-78 (2017)). After identifying desirable homologs, the flanking genomic neighborhoods of the Cascade gene can be inspected to locate and identify genes of the remaining Cascade subunit proteins as disclosed herein. As an example, additional Type I-F systems can be identified by locating Cas8 homologs (and additional Type I-F variant 2 systems can be identified by locating Cas5 homologs) and identifying promising bacterial species for homologous Cascade testing, and then obtaining or designing polynucleotide sequences encoding the Cas8, Cas5, and other protein components of the Cascade from those homologous CRISPR-Cas systems.

Polynucleotide DNA sequences of genes encoding the three, four, or five subunit proteins of Cascade from Types I-B, I-C, I-F, and I-F variant 2 from 12 additional homologous Cascade complexes, and the amino acid sequences of the resulting protein components, as well as exemplary minimal CRISPR arrays, are presented as SEQ ID NO:214 through SEQ ID NO:351 (Table 3). The polynucleotide sequences for the subunit proteins were derived from the gDNA of the host bacterium, and were codon-optimized specifically for expression in *E. coli*, and/or codon-optimized specifically for expression in eukaryotic cells (e.g., human cells). The polynucleotide DNA sequences encoding corresponding minimal CRISPR arrays were based on repeat sequences derived from the 12 species and can be used to generate mature crRNA that function as guide RNAs. In Table 5, the minimal CRISPR array comprises two repeat sequences (lower case, underlined) flanking an exemplary "spacer" sequence, which represents the guide portion of the crRNA. RNA processing by the endonuclease Cascade subunit generates a crRNA with repeat sequences on both the 5' and 3' ends, flanking the guide sequence.

TABLE 5

Minimal CRISPR Arrays

| SEQ ID NO: | Species | Minimal CRISPR repeat |
|---|---|---|
| SEQ ID NO: 226 | I-B_Fusobacterium nucleatum subsp. animalis 3_1_33 | atgaactgtaaacttgaaaagttttgaaatGTTGACAA ATATTCAGATAATTTTTCAAAATCTT TTatgaactgtaaacttgaaaagttttgaaat |
| SEQ ID NO: 239 | I-B_Campylobacter fetus subsp. testudinum Sp3 | gtttgctaatgacaatatttgtgttaaaacAAGCGTAG CACCAAAAGAAGCGTATGAAAGCAT AGgtttgctaatgacaatatttgtgttaaaac |
| SEQ ID NO: 252 | I-B_Odoribacter splanchnicus DSM 20712 | cttttaattgaactaaggtagaattgaaacTAGGAATA AACCGTACCCAACCACGTAGCCATA TACGcttttaattgaactaaggtagaattgaaac |
| SEQ ID NO: 262 | I-C_Bacillus halodurans C-125 | gtcgcactcttcatgggtgcgtggattgaaatCCTTTG ACGGAGAGGGGAACAGGAAATTAG AGAAGgtcgcactcttcatgggtgcgtggattgaaat |

TABLE 5-continued

Minimal CRISPR Arrays

| SEQ ID NO: | Species | Minimal CRISPR repeat |
|---|---|---|
| SEQ ID NO: 272 | I-C_Desulfovibrio vulgaris RCH1 plasmid pDEVAL01 | gtcgcccccacgcggggcgtggattgaaacCAGTC TCGTTACCCTGTCGCGGAGGGCGTCG ATgtcgcccccacgcggggcgtggattgaaac |
| SEQ ID NO: 282 | I-C_Geobacillus thermocatenulatus strain KCTC 3921 | gttgcaccggctattaagccgggtgaggattgaaacTA TATCACACAGCTTCTTAGTATCATCG ACAACACGTgttgcaccggctattaagccgggtg aggattgaaac |
| SEQ ID NO: 295 | I-F_Vibrio cholerae strain L15 | gttcactgccgtacaggcagatagaaaAATATGCA GGGGTTTGAAACGCTCGATGTTATgtt cactgccgtacaggcagcttagaaa |
| SEQ ID NO: 308 | I-F_Klebsiella oxytoca strain ICU1-2b | gttcactgccgtacaggcagcttagaaaAAAAACTG AGCGGCCGCAGAATGAAGTTGTAAgt tcactgccgtacaggcagcttagaaa |
| SEQ ID NO: 321 | I-F_Pseudomonas aeruginosa UCBPP-PA14 | gttcactgccgtgtaggcagctaagaaaACCACCCG CTACCACCGGCAGCCGCACCGGCCgtt cactgccgtgtaggcagctaagaaa |
| SEQ ID NO: 331 | I-Fv2_Shewanella putrefaciens CN-32 | gttcaccgccgcacaggcggcttagaaaTCAACCA AATCATAAATTGCGCGACCACATTGg ttcaccgccgcacaggcggcttagaaa |
| SEQ ID NO: 341 | I-Fv2_Acinetobacter sp. 869535 | gttcactgccatataggcagcttagaaaATCGTTTTT TCATACGAGATTCGAAACGGACAgttc actgccatataggcagcttagaaa |
| SEQ ID NO: 351 | I-Fv2_Vibrio cholerae HE48 | gttcactgccgcacaggcagatagaaaTAACCGGA GGCGTACACTCGATAGAGGCAGCGgt tcactgccgcacaggcagatagaaa |

Example 19A to Example 19I and Example 22A to Example 22C describe the design and testing of multiple Cascade complex homologs, each comprising a Cas subunit protein-FokI fusion protein, to evaluate the efficiency of genome editing for each Cascade complex. The highest editing was observed with the variant from *Pseudomonas* sp. S-6-2, while other homologs (i.e., *Salmonella enterica*, *Geothermobacter* sp. EPR-M, *Methanocella arvoryzae* MRE50, and *S. thermophilus* (strain ND07)) showed editing approximately equivalent to *E. coli*. Editing was also observed with engineered *Vibrio cholera* strain L15 (Type I-F) FokI-Cascade complexes and *Vibrio cholera* strain HE48 (Type I-Fv2) FokI-Cascade complexes. In one embodiment, the different PAM requirements of these different homologs can increase target density in a target polynucleotide (e.g., gDNA in a cell). Accordingly, this collection of Cascade complex homologs provides greater flexibility in selection of nucleic acid target sequences in a target polynucleotide (e.g., gDNA in a cell).

In a second aspect, the present invention relates to modified Cascade subunit proteins. Cascade subunit proteins suitable for modification include, but are not limited to, Cascade subunit proteins of the species described herein.

In one embodiment, the present invention relates to engineered circular permutations of Cascade subunit proteins. Such circular permutations of a Cascade subunit protein result in a protein structure having different connectivity of the original linear sequence of amino acids of the Cascade subunit protein, but having an overall similar three-dimensional shape (see, e.g., Bliven, S., et al., PLoS Comput. Biol. 8: e1002445 (2012)). Circular permutations of Cascade subunit proteins can have a number of advantages. For example, a circular permutation of a Cas7 subunit protein can create a new N-terminus and a new C-terminus designed to be positioned for connection with an additional polypeptide sequence to form a fusion protein or linker region without disturbing the Cas7 protein fold or the Cascade complex assembly. Three examples of circular permutations of Cas7 (circularly permuted Cas7, cpCas7) are illustrated in FIG. 3A and FIG. 3B. In FIG. 3A and FIG. 3B, three portions of the protein are shown: an N-terminal portion of the native protein (FIG. 3A, vertical stripes, e.g., a Cas7 protein), a central portion of the native protein (FIG. 3A, grey shading), and a C-terminal portion of the native protein (FIG. 3A, no shading). FIG. 3A illustrates relocation of an N-terminal portion of the native protein to the C-terminal position of the native protein to produce a circularly permuted protein (FIG. 3A, cpCas7), wherein the N-terminal portion of the native protein is now at the N-terminal end of the cpCas7 and is connected to the central portion of the native protein by a linker polypeptide (FIG. 3A, Linker). FIG. 3B illustrates relocation of a C-terminal portion of the native protein (FIG. 3B, Cas7) to the N-terminal position of the native protien (FIG. 3B, cpCas7), wherein the C-terminal portion of the native protein is now at the N-terminal end of the cpCas7 and is connected to the central portion of the native protein by a linker polypeptide (FIG. 3B, Linker).

The data presented in Example 10A, Example 10B, and Example 10 show that purification of Cascade complexes comprising circularly-permuted Cas7 subunit protein variants demonstrate that circularly-permuted Type I-E CRISPR-Cas subunit proteins can be successfully used to form Cascade complexes having essentially the same composition (based on molecular weight) as Cascade complexes comprising wild-type proteins.

In another embodiment, the present invention relates to Cascade subunit proteins fused to additional polypeptide sequences to create fusion proteins, as well as polynucleotides encoding such fusion proteins. Additional polypeptide sequences can include, but are not limited to, proteins, protein domains, protein fragments, and functional domains. Examples of such additional polypeptide sequences include, but are not limited to, sequences derived from transcription activator or repressor domains, and nucleotide deaminases (e.g., a cytidine deaminase or an adenine deaminase such as described in Komor, et. al., Nature 553:420-424 (2016); Koblan, et. al., Nat. Biotechnol. doi: 10.1038/nbt.4172 (May 29, 2018)). Additional functional domains for fusion proteins are presented herein.

An additional polypeptide sequence can be fused to any of the Cascade subunit proteins wherein the additional polypeptide sequence is encoded by an additional polynucleotide sequence that is typically appended to either the 5' or 3' end of a polynucleotide comprising the coding sequence of a Cascade subunit protein. In some embodiments, additional polynucleotide sequences that encode amino acid linkers connect a Cascade subunit protein to the additional polypeptide sequences of interest. In some embodiments, the polynucleotide sequences for the fusion protein partner and the linker sequence can be derived from naturally occurring gDNA sequences or may be codon-optimized for bacterial expression in *E. coli* or eukaryotic expression in mammalian cells (e.g., human cells). Examples of fusions proteins comprising affinity tags (e.g., His6, Strep-tag® II (IBA GMBH LLC, Göttingen, Germany)), nuclear localization signal or sequence (NLS), maltose binding protein, and FokI are presented in Example 1. Exemplary amino acid linker sequences are also disclosed in Example 1.

Example 11A describes Cascade subunit protein-FokI fusions, as well as Cascade subunit protein fusions to cytidine deaminases, endonucleases, restriction enzymes, nucleases/helicases, or domains thereof. Example 11B describes Cascade subunit protein fusions with other Cascade subunit proteins, as well as Cascade subunit protein fusions with other Cascade subunit fusion proteins and an enzymatic protein domain (Example 11D). In some embodiments, a Type I CRISPR subunit protein can be evaluated in silico for the ability to be used to generate protein fusions at the N-terminus, C-terminus, or positions between the N-terminus and the C-terminus. In some embodiments, a Type I CRISPR subunit protein can be linked to one or more fusion domains at the N-terminus, C-terminus, or positions between the N-terminus and the C-terminus using one or more polypeptide linkers. In some embodiments, a Cascade subunit protein can be fused to a single-chain FokI (e.g., a single chain FokI fusion to EcoCascade RNP complex; nucleotide sequence, SEQ ID NO:1926; protein sequence, SEQ ID NO:1927). Exemplary polypeptide linkers are set forth in Examples 1, 11, 18, and 19.

Figure 4B:
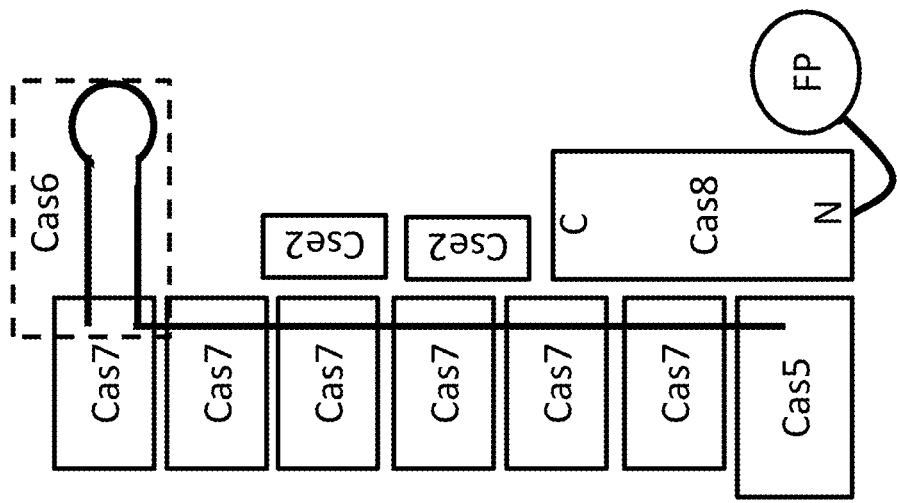
FIG. 4A, FIG. 4B, FIG. 5A, FIG. 5B, FIG. 6A, FIG. 6B, FIG. 6C, FIG. 7A, FIG. 7B, FIG. 8, FIG. 9, FIG. 10A, and FIG. 10B illustrate a variety of examples of engineered Type I CRISPR-Cas effector complexes of the present invention.
Figure 4A:
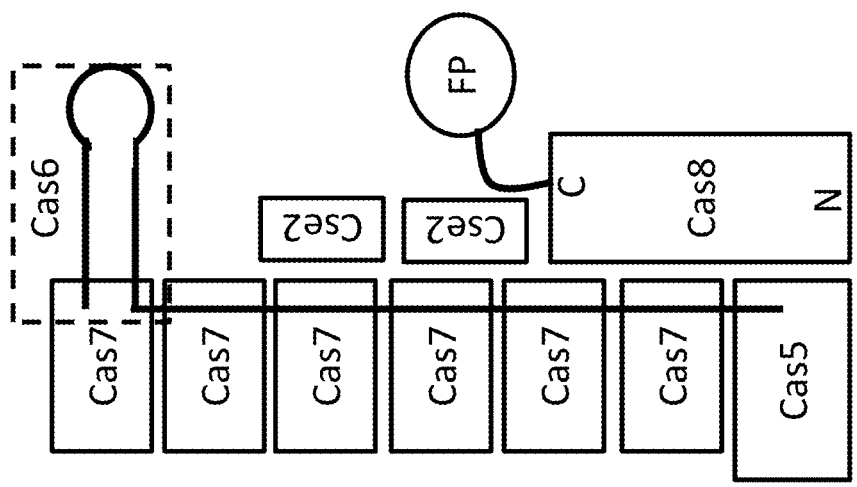

FIG. 4A and FIG. 4B illustrate Cascade complexes comprising a Cas8 subunit protein (FIG. 4A, FIG. 4B, Cas7, Cas5, Cas8, Cse2, Cas6, the dashed box around Cas6 indicates its interaction with the crRNA hairpin; the cRNA is illustrated as a black line comprising the hairpin; and Cas8, "C" C-terminal, "N" N-terminal are indicated) fused to an additional protein sequence (e.g., a FokI). FIG. 4A shows an example of the additional protein sequence (FIG. 4A, FP) connected with the C-terminus of a Cas8 subunit protein using a linker polypeptide (FIG. 4A, black curved line). FIG. 4B shows an example of the additional protein sequence (FIG. 4B, FP) connected with the N-terminus of a Cas8 subunit protein using a linker polypeptide (FIG. 4B, black curved line). Example 11A describes in silico design, cloning, expression, and purification of a Type I-E Cas8 fused N-terminally with a FokI nuclease domain.

Figure 5B:
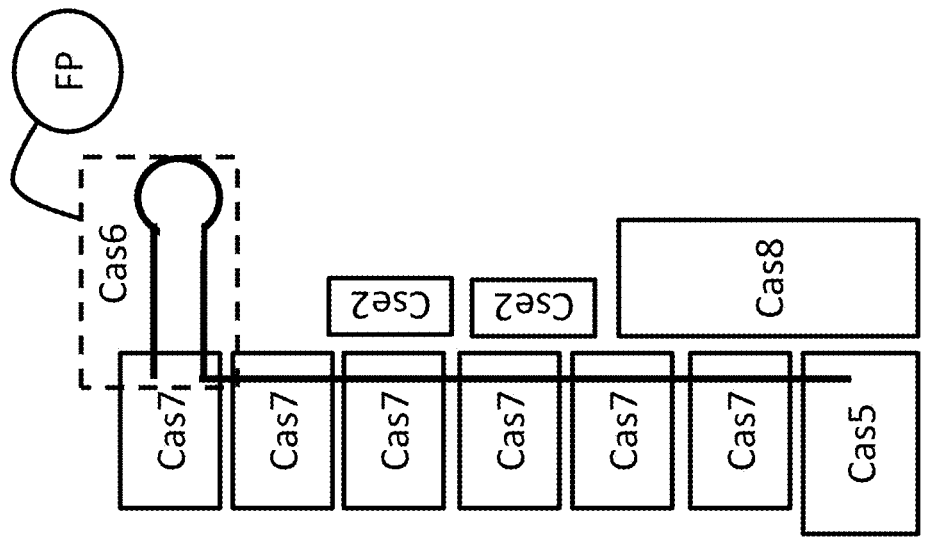
Figure 5A:
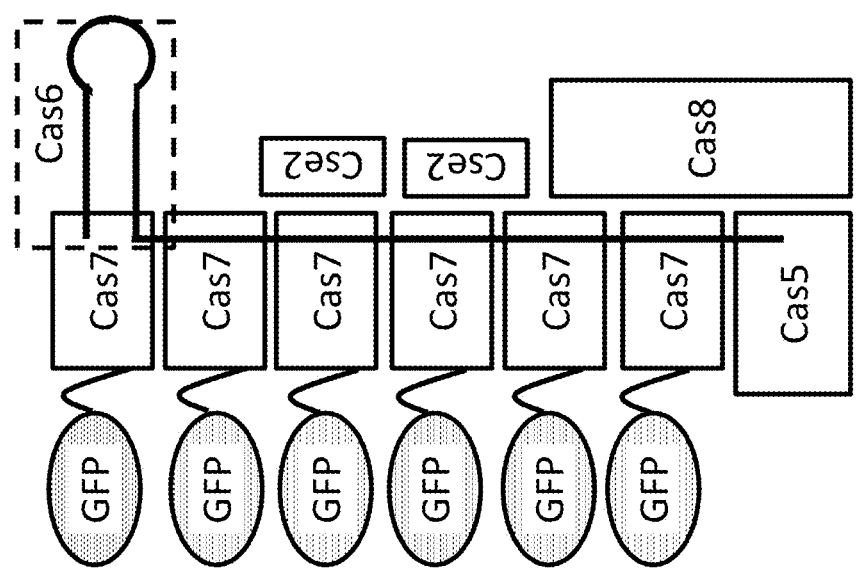

FIG. 5A and FIG. 5B illustrate additional examples of Cascade complexes comprising a Cascade subunit protein fused to an additional protein sequence. In FIG. 5A and FIG. 5B, the cRNA is illustrated as a black line comprising the hairpin and the relative positions of the Cas proteins of the Cascade complex are shown (FIG. 5A, FIG. 5B: Cas7, Cas5, Cas8, Cse2, Cas6; the dashed box around Cas6 indicates its interaction with the crRNA hairpin). FIG. 5A shows an example of a detectable moiety (e.g., a green fluorescent protein; FIG. 5A, GFP) fused to each of six Cas7 subunit proteins, each via a linker polypeptide (FIG. 5A, curved black line). Such a Cascade complex can be useful for detection of binding of the complex to a nucleic acid target sequence by providing significant signal amplification as a result of the presence of the multiple detectable moieties associated with the Cascade complex. FIG. 5B shows an example of an additional protein sequence (FIG. 5B, FP) connected with Cas6 subunit protein using a linker polypeptide (FIG. 5B, curved black line).

Examples of fusion proteins containing *E. coli* Type I-E Cascade subunit proteins include, but are not limited to, the following: the same subunit (e.g., Cse2_linker_Cse2), circularly permuted subunits (e.g., cpCas7_linker_cpCas7_linker_cpCas7_linker_cpCas7_linker_cpCas7_linker_cpCas7), a Type I-E Cascade protein fused to a nuclease (e.g., FokI_linker_Cas8, Cas3_linker_Cas8, Cas6_linker_FokI, S1Nuclease_linker_Cse2_linker_Cse2), a Type I-E Cascade protein fused to a cytidine deaminase (e.g., Cas8_linker_AID, Cse2_linker_Cse2_linker_APOBEC3G), and a Type I-E Cascade protein fused one or more other Type I-E Cascade proteins (e.g., Cas6_linker_cpCas7_linker_cpCas7_linker_cpCas7_linker_cpCas7_linker_cpCas7_linker_cpCas7, cpCas7_linker_cpCas7_linker_cpCas7_linker_cpCas7_linker_cpCas7_linker_cpCas7_linker_Cas5, Cas6_linker_cpCas7_linker_cpCas7_linker_cpCas7_linker_cpCas7_linker_cpCas7_linker_cpCas7_linker_Cas5).

Figure 6C:
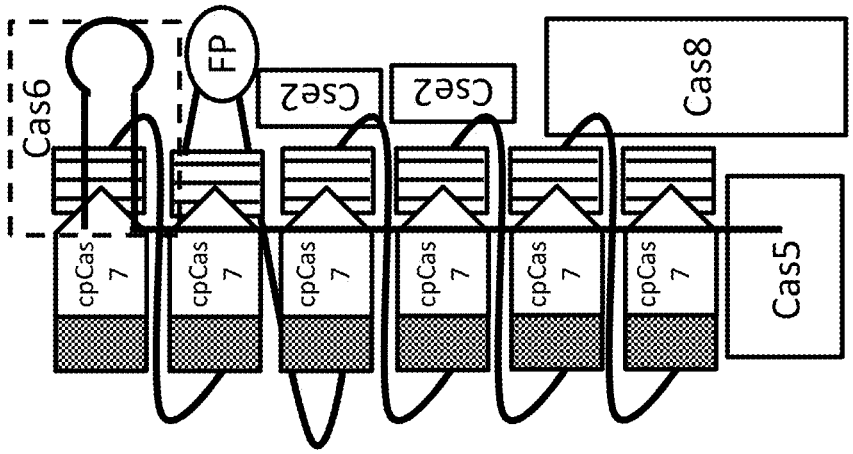
Figure 6B:
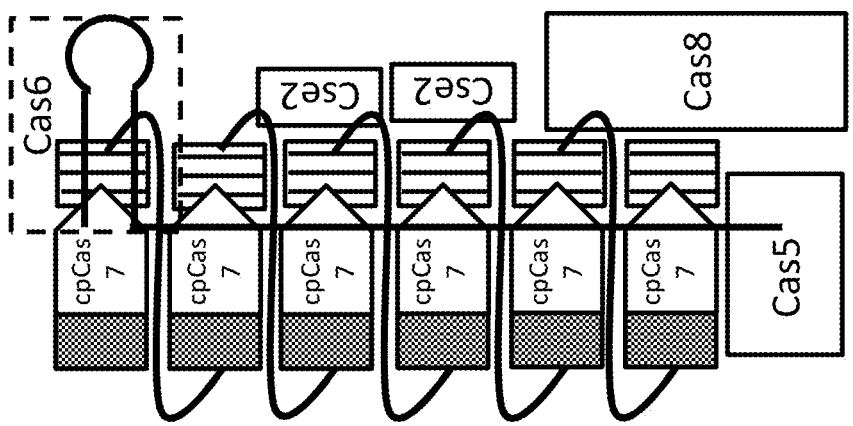
Figure 6A:
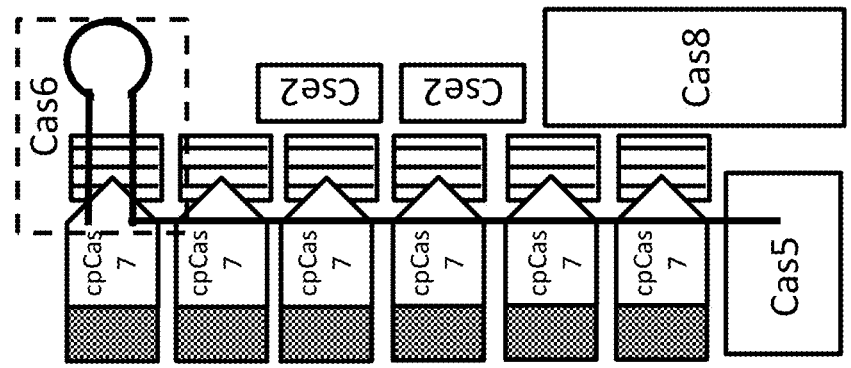

FIG. 6A, FIG. 6B, and FIG. 6C present illustrations of engineered Type I CRISPR-Cas effector complexes that contain cpCas7. In FIG. 6A, FIG. 6B, and FIG. 6C, "cpCas7" is a circularly permuted Cas7 protein (FIG. 6A, FIG. 6B, FIG. 6C: cpCas7, Cas5, Cas8, Cse2, and Cas6; the dashed box around Cas6 indicates its interaction with the crRNA hairpin; the cRNA is illustrated as a black line comprising the hairpin; for cpCas7 the shading corresponds to the circularly permuted protein illustrated in FIG. 3A), and the relative positions of the Cas proteins of the Cascade complex are shown. FIG. 6A presents a Cascade complex comprising six individual cpCas7 subunit proteins (FIG. 6A, cpCas7). FIG. 6B presents a Cascade complex comprising six fused cpCas7 subunit proteins, wherein the C-terminus of a cpCas7 subunit protein (FIG. 6B, cpCas7) is connected with the N-terminus of an adjacent cpCas7 subunit protein using a linker polypeptide (FIG. 6B, linker polypeptide is illustrated as a dark black line connecting the cpCas7 subunit proteins). FIG. 6C presents an embodiment wherein the Cascade complex comprises six fused cpCas7 subunit proteins (a "backbone"), wherein the C-terminus of the first cpCas7 subunit protein is connected with the N-terminus of the second cpCas7 subunit protein using a linker polypeptide (FIG. 6C, linker polypeptide is illustrated as a dark black line connecting the cpCas7 subunit proteins), the C-terminus of the second cpCas7 subunit protein is connected with the N-terminus of a different protein sequence (FIG. 6C, FP)

(e.g., a cytidine deaminase) using linker polypeptides (FIG. 6C, straight black lines connecting cpCas7 and FP), and the C-terminus of this protein coding sequence is connected with the N-terminus of the third cpCas7 using a linker polypeptide. One advantage of such a fused backbone of cpCas7 subunit proteins is that an additional protein sequence can be introduced at a specific location along the backbone to provide access of the additional protein sequence to different locations along the length of the nucleic acid target sequence to which the guide directs binding of the Cascade complex.

Figure 7B:
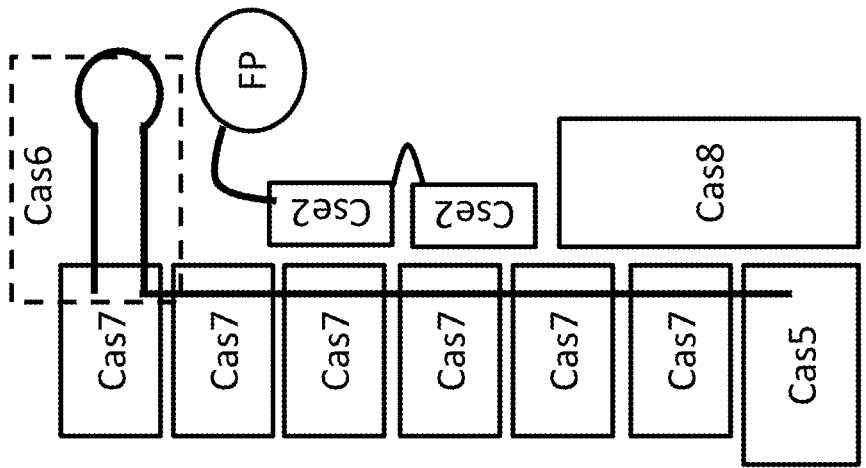
Figure 7A:
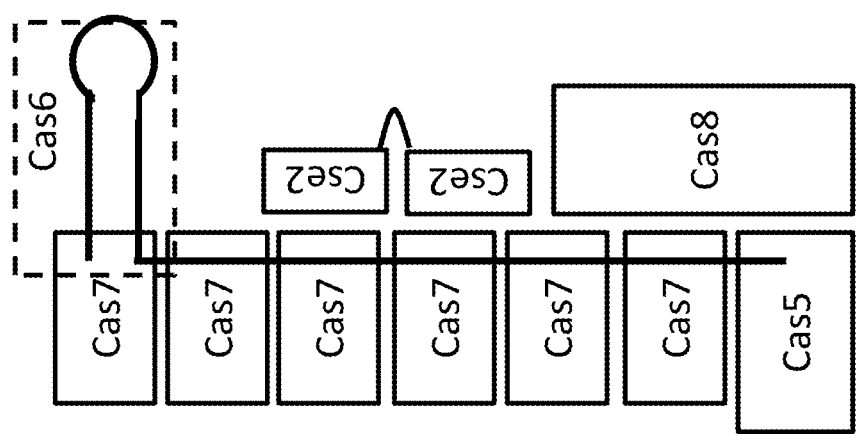

FIG. 7A and FIG. 7B illustrate further embodiments of engineered Type I CRISPR-Cas effector complexes comprising fusion proteins. In FIG. 7A and FIG. 7B, the relative positions of the Cas proteins of the Cascade complex are shown (FIG. 7A, FIG. 7B: Cas7, Cas5, Cas8, Cse2, and Cas6; the dashed box around Cas6 indicates its interaction with the crRNA hairpin; the cRNA is illustrated as a black line comprising the hairpin). FIG. 7A shows a Cascade complex comprising a Cse2-Cse2 fusion protein (FIG. 7A, two Cse2 proteins connected by a curved black line). In silico design, cloning, expression, purification, and electrophoretic mobility shift assays are described in Example 11B and Example 11C Cascade complexes comprising Cse2-Cse2 fusion proteins. FIG. 7B shows a Cascade complex comprising a Cse2-Cse2 fusion protein connected via a linker polypeptide (FIG. 7B, curved black line connecting Cse2 protein to FP) with an additional protein sequence (FIG. 7B, FP). Example 11D describes in silico design, cloning, expression, and purification of a Cse2-Cse2 protein fused to a cytidine deaminase.

In some embodiments, one or more nuclear localization signals can be added at the engineered N-terminus or C-terminus of a Cascade protein subunit (e.g., a Cas8-FokI fusion protein, a cpCas7 protein, or a Cse2-Cse2 fusion protein).

In some embodiments of fusion polypeptides, linker polypeptides connect two or more protein coding sequences. The length of exemplary linker polypeptides is described in the Examples. Typically, linker lengths include, but are not limited to, between about 10 amino acids and about 40 amino acids, between about 15 amino acids and about 30 amino acids, and between about 17 amino acids and about 20 amino acids. The amino acid composition of linker polypeptides typically comprises amino acids that are polar, small, and/or charged (e.g., Gly, Ala, Leu, Val, Gln, Ser, Thr, Pro, Glu, Asp, Lys, Arg, His, Asn, Cys, Tyr). In additional embodiments, linker polypeptides are designed such that they do not contain methionine, and the fusion is designed to avoid cryptic translation initiation sites. Following the guidance of the present Specification, the linker polypeptide is designed to provide appropriate spacing and positioning of the functional domain and the Cascade protein within the fusion protein (see, e.g., Chichili, C., et al., Protein Science 22:153-167 (2013); Chen, X., et al., 65:1357-1369 (2013); George, R., et al., Protein Engineering, Design and Selection 15:871-879 (2002)). Additional examples of linker polypeptides useful in the practice of the present invention are linker polypeptides identified that connect coding sequences of Cascade proteins to each other in organisms comprising Cascade systems (e.g., the linker polypeptide that connects Cas8 to Cas3 in *Streptomyces griseus* as described by Westra, E. R., et al., Mol, Cell. 46: 595-605 (2012)).

Fusion protein coding DNA sequences can be codon-optimized for expression in a selected organism such as bacteria, archae, plants, fungi, or mammalian cells. Codon-optimizing programs are widely available, such as on the Integrated DNA Technologies website (www.idtdna.com/CodonOpt), or through Genscript® (Genscript, Piscataway, NJ) services. To facilitate cloning into the recipient expression vector, additional sequences overlapping with the vector compatible for SLIC cloning (see, e.g., Li, M., et al., Methods Mol. Biol. 852:51-59 (2012)) can be appended at the 5' and 3' ends of the DNA sequence.

In other embodiments, Cascade subunit proteins can be fused to transcription activation and/or repression domains. In some embodiments, a fusion protein can comprise activator domains (e.g., heat shock transcription factors, NFKB activators, VP16, and VP64 (see, e.g., Eguchi, A. et. al., Proc. Natl. Acad. Sci. USA 113: E8257-E8266 (2016); Perez-Pinera, P. et. al., Nature Methods 10:973-6 (2013); Gilbert, L. A., et. al. Cell 159:647-61 (2014)) or repressor domains (e.g., a KRAB domain). In some embodiments, linker nucleic acid sequences are used to join the two or more coding sequences for proteins, protein domains, or protein fragments.

Figure 8:
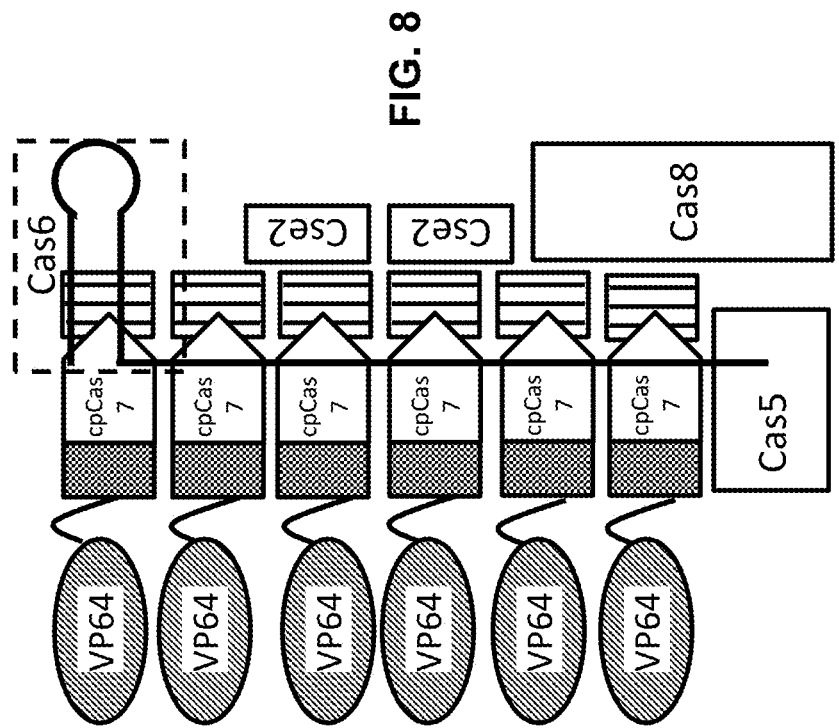

Cascade complexes comprising Type I CRISPR-Cas subunit proteins fused to transcription activators can be used to activate the expression of the gene. The target locus can contain a transcriptional start site (TSS) that typically harbors one or more binding site for the transcriptional activation machinery (factors) of a cell. FIG. 8 illustrates a Cascade complex comprising six fusion proteins comprising a cpCas7 (compare to FIG. 3A) connected via a linker polypeptide (FIG. 8, curved black line connecting cpCas7 to VP64) to the transcriptional activator VP64. In FIG. 8, crRNA is illustrated as a dark black line comprising a hairpin, and the relative positions of the Cas proteins of the Cascade complex are shown (FIG. 8: cpCas7, Cas5, Cas8, Cse2, and Cas6; the dashed box around Cas6 indicates its interaction with the crRNA hairpin). Such engineering of a Cascade complex converts the complex into a flexible tool for transcriptional activation of a gene (CASCADEa), wherein targeting a selected gene is achieved by selection of a guide sequence that directs binding of the Cascade complex to one or more regulatory elements (e.g., a TSS) of the selected gene. Example 12 describes the design of a *E. coli* Type I-E cp-Cas7 protein fused to a VP64 activation domain to confer transcriptional activation activity to the Cascade complex. Transcription activators include, but are not limited to, homeodomain proteins, zinc-finger proteins, winged-helix (forkhead) proteins, leucine-zipper proteins, helix-loop-helix proteins, heterodimeric transcription factors, activation domains, and transcription factors that bind enhancers (see, e.g., Molecular Cell Biology, Harvey Lodish, et al., W H Freeman & Co; (2002) ISBN 978-0849394805).

In addition, Cascade complexes comprising Type I CRISPR-Cas subunit proteins fused to transcription repressors can be used to repress the expression of the gene. The target locus can comprise transcriptional regulatory elements. In one embodiment, a Cascade subunit protein can be connected to a KRAB domain via a linker polypeptide. A Cascade complex comprising the Cascade subunit protein/KRAB domain fusion can convert the complex into a flexible tool for transcriptional repression of a gene (CASCADEi), wherein targeting a selected gene is achieved by selection of a guide sequence that directs binding of the Cascade complex to one or more regulatory elements of the selected gene. Transcriptional repressors include, but are not limited to, passive transcriptional repressors, bzip transcription factor family, sp1-like transcriptional repressors, active transcriptional repressors (e.g., transcriptional repression via recruitment of histone deacetylases, histone deacetylation, and dual-specific repressors (see, e.g., Thiel, G., et al., Eur. J. Biochem. 271:2855-2862 (2004); Nicola Reynolds, N., et al., Development 140:505-512 (2013); Gaston, K., et al., Cell Mol. Life Sci., 60:721-741 (2003)).

In additional embodiments, Cascade subunit proteins can be fused to affinity tags.

Figure 9:
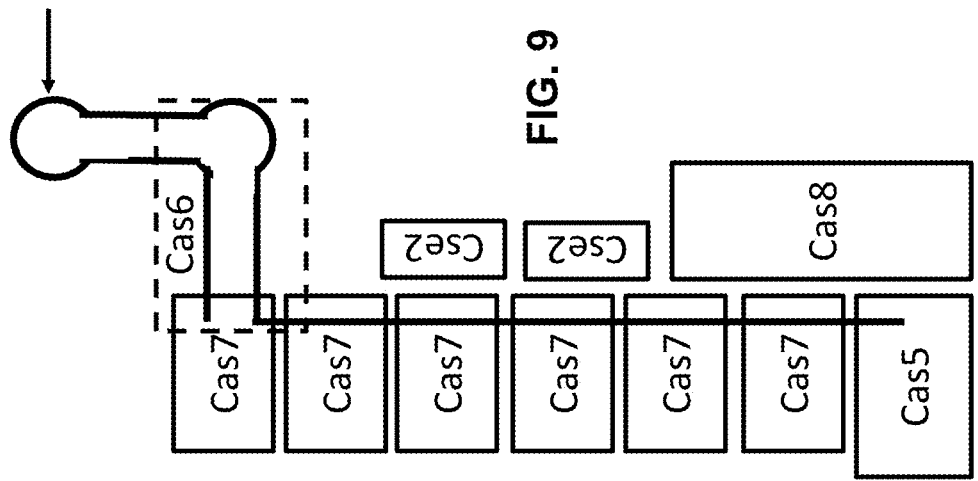

In other embodiments of the present invention, Type I CRISPR-Cas guide polynucleotides can be modified by insertion of a selected polynucleotide element or changes of a nucleotides at selected positions within the guide polynucleotides (e.g., a fundamentally different change of a DNA moiety for an RNA moiety, as well as other changes described above for guide polynucleotides). Such embodiments include, but are not limited to, Type I CRISPR-Cas guide polynucleotides 5', 3', or internally fused to one or more nucleotide effector domain (e.g., an MS2 or MS2-P65-HSF1 binding RNA or aptamer that recruits transcription factors). FIG. 9 illustrates a Type I CRISPR guide polynucleotide and the relative positions of the Cas proteins of the Cascade complex are shown (FIG. 9: Cas7, Cas5, Cas8, Cse2, and Cas6; the dashed box around Cas6 indicates its interaction with the crRNA hairpin; the cRNA is illustrated as a black line comprising the hairpin within the dashed box). In FIG. 9, the crRNA further comprises an RNA aptamer hairpin (FIG. 9, position indicated by the arrow) introduced into the 3' hairpin of the guide polynucleotide.

Figure 10B:
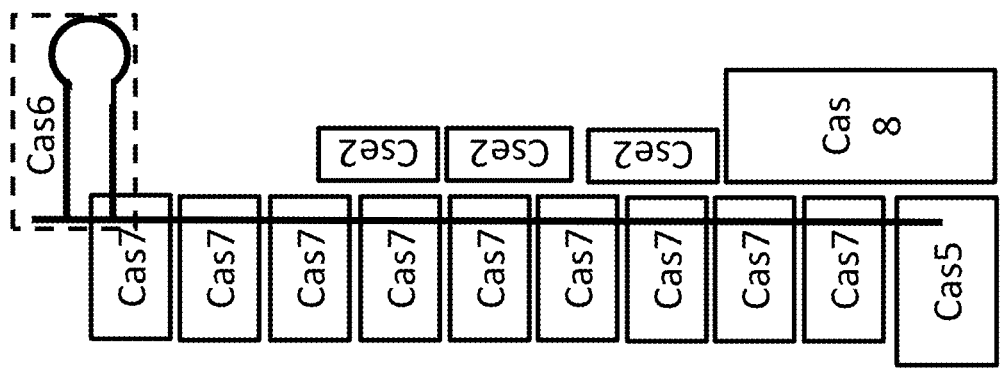
Figure 10A:
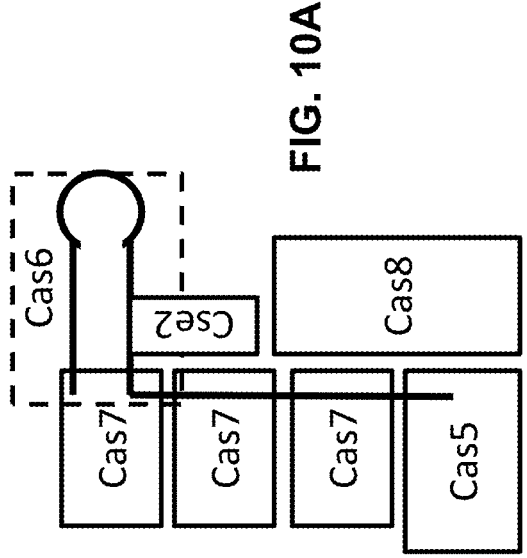

The length of Type I CRISPR-Cas guides can also be modified, typically by lengthening or shortening the Cas7 subunit protein and Cse2 subunit protein binding region. FIG. 10A illustrates a Cascade complex with three Cas7 subunits, one Cse2 subunit, and a shortened crRNA (FIG. 10A: Cas7, Cas5, Cas8, Cse2, and Cas6; the dashed box around Cas6 indicates its interaction with the crRNA hairpin; the cRNA is illustrated as a black line comprising the hairpin). FIG. 10B illustrates a Cascade complex with nine Cas7 subunits, three Cse2 subunits, and a lengthened crRNA (FIG. 10B: Cas7, Cas5, Cas8, Cse2, and Cas6; the dashed box around Cas6 indicates its interaction with the crRNA hairpin; the cRNA is illustrated as a black line comprising the hairpin).

Example 16 describes the generation and testing of modifications of Type I CRISPR-Cas guide crRNAs and the suitability of the modified guides for use in constructing engineered Type I CRISPR-Cas effector complexes.

In a third aspect, the present invention relates to nucleic acid sequences encoding one or more engineered Cascade components, as well as expression cassettes, vectors, and recombinant cells comprising nucleic acid sequences encoding one or more engineered Cascade components. Some embodiments of the third aspect of the invention include one or more polypeptide encoding all the components of a selected Cascade system (e.g., Cse2, Cas5, Cas6, Cas7, and Cas8 proteins, and one or more cognate guides), wherein the components are capable of forming an effector complex. Typically, when more than one cognate guide is expressed, the guides have different spacer sequences to direct binding to different nucleic acid target sequences. Such embodiments include, but are not limited to, expression cassettes, vectors, and recombinant cells.

In one embodiment, the present invention relates to one or more expression cassettes comprising one or more nucleic acid sequences encoding one or more engineered Cascade components. Expression cassettes typically comprise a regulatory sequence involved in one or more of the following: regulation of transcription, post-transcriptional regulation, or regulation of translation. Expression cassettes can be introduced into a wide variety of organisms including, but not limited to, bacterial cells, yeast cells, plant cells, and mammalian cells (including human cells). Expression cassettes typically comprise functional regulatory sequences corresponding to the organism(s) into which they are being introduced.

A further embodiment of the present invention relates to vectors, including expression vectors, comprising one or more nucleic acid sequences encoding one or more one or more engineered Cascade components. Vectors can also include sequences encoding selectable or screenable markers. Furthermore, nuclear targeting sequences can also be added, for example, to Cascade subunit proteins. Vectors can also include polynucleotides encoding protein tags (e.g., poly-His tags, hemagglutinin tags, fluorescent protein tags, and bioluminescent tags). The coding sequences for such protein tags can be fused to, for example, one or more nucleic acid sequences encoding a Cascade subunit protein.

General methods for construction of expression vectors are known in the art. Expression vectors for host cells are commercially available. There are several commercial software products designed to facilitate selection of appropriate vectors and construction thereof, such as insect cell vectors for insect cell transformation and gene expression in insect cells, bacterial plasmids for bacterial transformation and gene expression in bacterial cells, yeast plasmids for cell transformation and gene expression in yeast and other fungi, mammalian vectors for mammalian cell transformation and gene expression in mammalian cells or mammals, and viral vectors (including, but not limited to, lentivirus, retrovirus, adenovirus, herpes simplex virus I or II, parvovirus, reticuloendotheliosis virus, and adeno-associated virus (AAV) vectors) for cell transformation and gene expression and methods to easily allow cloning of such polynucleotides.

AAV-based vectors (rAAV) are one example of viral vectors useful in the practice of methods of the present invention. AAV is a single-strand DNA member of the family Parvoviridae, and is a naturally replication-deficient virus. AAV vectors are among the viral vectors most frequently used for gene therapy. Twelve human serotypes of AAV (AAV serotype 1 [AAV-1] to AAV-12) and more than 100 serotypes from non-human are known. In one embodiment, AAV-6 is used as a vector.

Lentiviral vectors are another example of viral vectors useful in the practice of methods of the present invention. Lentivirus is a member of the Retroviridae family and is a single-stranded RNA virus, which can infect both dividing and non-dividing cells as well as provide stable expression through integration into the genome. To increase the safety of lentiviral vectors, components necessary to produce a viral vector are split across multiple plasmids. Transfer vectors are typically replication incompetent and may additionally contain a deletion in the 3'LTR, which renders the virus self-inactivating after integration. Packaging and envelope plasmids are typically used in combination with a transfer vector. For example, a packaging plasmid can encode combinations of the Gag, Pol, Rev, and Tat genes. A transfer plasmid can comprise viral LTRs and the psi packaging signal. The envelope plasmid usually comprises an envelope protein (usually vesicular stomatitis virus glycoprotein, VSV-GP, because of its wide infectivity range).

Illustrative plant transformation vectors include those derived from a Ti plasmid of *Agrobacterium tumefaciens* (see, e.g., Lee, L. Y., et al., Plant Physiology 146:325-332 (2008)). Also, useful and known in the art are *Agrobacterium rhizogenes* plasmids. For example, SNAPGENE™ (GSL Biotech LLC, Chicago, IL; snapgene.com/resources/plasmid_files/your_time_is_valuable/) provides an extensive list of vectors, individual vector sequences, and vector maps, as well as commercial sources for many of the vectors.

In order to express and purify recombinant Cascade in a bacterial expression system, vectors can be designed that encode Cascade subunit proteins, as well as a minimal CRISPR arrays comprising guide sequences of interest. Accordingly, one aspect of the present invention includes such expression systems. In one embodiment, the Cascade complex is expressed off of three distinct plasmid vectors, which collectively encode the following components: a Cas8 protein; Cse2, Cas7, Cas5, and Cas6 proteins; and a CRISPR RNA. In some embodiments, the expression plasmid encoding Cas8 comprises the natural gDNA gene sequence and, in other embodiments, the expression plasmid can encode Cas8 that is codon-optimized for expression in a chosen cell type. Similarly, the expression plasmid encoding Cse2, Cas7, Cas5, and Cas6 can contain the natural gDNA gene sequences or can contain gene sequences that have been codon-optimized for expression in a chosen cell type. In some embodiments, the entire Cascade subunit protein coding operon can be placed downstream of a single transcriptional promoter, such that the different proteins are all translated from a single polycistronic transcript. In additional embodiments, the gene encoding the Cascade subunit proteins can be separated from each other, with intervening transcriptional terminators and promoters.

The expression plasmid encoding the crRNA may contain as few as two repeats flanking a single spacer sequence, downstream of an appropriate transcriptional promoter, or may contain many repeats flanking multiple spacer sequences, of either the same exact guide sequence or multiple distinct guide sequences. Coordinated expression of the CRISPR and the Cascade subunits, in particular the Cas6 subunit, lead to processing of long precursor crRNAs into the mature length crRNA, each one of which comprises fragments of a single repeat on the 5' and 3' ends of the crRNA, and a single spacer sequence in the middle.

An alternative strategy to express the complete Cascade complex in *E. coli* uses two plasmids: one plasmid that encodes the entire Cas8-Cse2-Cas7-Cas5-Cas6 operon on a single expression plasmid and one plasmid that encodes the CRISPR RNA. In this case, the 5' end of the Cse2 gene, which normally overlaps with the 3' end of the Cas8 gene, is separated spatially from the 3' end of the Cas8 gene, in order to append a polynucleotide sequence encoding an affinity tag and/or protease recognition sequence.

Example 2 describes two types of bacterial expression plasmid systems for the Cascade proteins: the first type comprises two plasmids, a first plasmid encoding the Cas8 protein and a second encoding the 4 subunit proteins of the CasBCDE complex (cse2-cas7-cas5-cas6 operon); and the second type comprises an expression plasmid encoding all five subunit proteins of the Cascade complex (cas8-cse2-cas7-cas5-cas6 operon). Cognate CRISPR arrays are also described.

In order to facilitate purification of Cascade complexes, an affinity tag can be appended onto the Cse2 subunit, such as an N-terminal Strep-II tag or a hexahistidine (His6) tag. Furthermore, an amino acid sequence recognized by a protease, such as TEV protease or the HRV3C protease can be inserted between the affinity tag and the native N-terminus of the Cse2 subunit, such that biochemical cleavage of the sequence with the protease after initial purification liberates the affinity tag from the final recombinant Cascade complex. The affinity tag may also be placed on other subunits, or left on the Cse2 subunit and combined with additional affinity tags on other subunits. Exemplary Cascade subunit proteins comprising affinity tags are set forth in Example 1, Example 2, Example 3A, Example 3B, and Example 3C.

For Type I-E Cascade systems, a strain of *E. coli* can be transformed with plasmids encoding the CRISPR RNA as well as the cse2-cas7-cas5-cas6 genes, protein expression induced, and a Cascade complex that is lacking the Cas8 subunit can be produced. This Cascade complex typically is referred to as a Cas8-minus Cascade complex, or alternatively as a CasBCDE complex (see, e.g., Jore, M., et al., Nat. Struct. Mol. Biol. 18:529-536 (2011)). This purified complex can be biochemically combined with separately purified Cas8 to reconstitute full Cascade (see, e.g., Sashital, D. G., et al., Mol. Cell 46:606-615 (2012)).

Table 6 presents exemplary sequences of bacterial expression plasmids encoding the minimal CRISPR array, cas8, cse2-cas7-cas5-cas6 constructs, and cas8-cse2-cas7-cas5-cas6 constructs, containing different tags and designs. Plasmids that encode Cascade complexes and Cascade complexes from homologous Type I systems can be designed similarly as the exemplary expression plasmid sequences for the Type I-E found in *E. coli* K-12 MG1655 following the guidance of the present Specification. Table 6 additionally contains sequences of expression plasmids expressing Cas8-Cse2-Cas7-Cas5-Cas6 proteins as well as FokI fusions to either the cas8 gene or the cas6 gene, for the production of nuclease-Cascade fusions for gene editing experiments.

TABLE 6

Vectors for Production of Cascade Effector Complexes

| SEQ ID NO: | Description | Effector complex species of origin | Type of sequence |
|---|---|---|---|
| SEQ ID NO: 352 | minimal CRISPR array | I-E_*E. coli* K-12 MG1655 | Spacer sequence targets J3 |
| SEQ ID NO: 353 | minimal CRISPR array | I-E_*E. coli* K-12 MG1655 | Spacer sequence targets CCR5.1 |
| SEQ ID NO: 354 | minimal CRISPR array (J3/L3) | I-E_*E. coli* K-12 MG1655 | Minimal CRIPSR array spacers sequence targets J3 and L3 |
| SEQ ID NO: 355 | minimal CRISPR array (Hsa07) | I-E_*E. coli* K-12 MG1655 | Minimal CRISPR array spacers sequence targets Hsa07 |
| SEQ ID NO: 356 | His6-MBP-TEV-Cas8 | I-E_*E. coli* K-12 MG1655 | Derived from gDNA, with appended tags |
| SEQ ID NO: 357 | StrepII-HRV3C-Cse2__Cas7__Cas5__Cas6 | I-E_*E. coli* K-12 MG1655 | Derived from gDNA, with appended tags |
| SEQ ID NO: 358 | Cas8__His6-HRV3C-Cse2__Cas7__Cas5__Cas6 | I-E_*E. coli* K-12 MG1655 | Derived from gDNA, with appended tags |
| SEQ ID NO: 359 | FokI-30aa-Cas8__His6-HRV3C-Cse2__Cas7__Cas5__Cas6 | I-E_*E. coli* K-12 MG1655 | Derived from gDNA, with appended tags |
| SEQ ID NO: 360 | FokI-30aa-Cas8__His6-HRV3C-Cse2__Cas7__Cas5__NLS-Cas6 | I-E_*E. coli* K-12 MG1655 | Derived from gDNA, with appended tags |
| SEQ ID NO: 361 | FokI-30aa-Cas8__His6-HRV3C-Cse2__Cas7-NLS__Cas5__Cas6 | I-E_*E. coli* K-12 MG1655 | Derived from gDNA, with appended tags |
| SEQ ID NO: 362 | Cas8__His6-HRV3C-Cse2__Cas7__Cas5__Cas6-20aa-FokI | I-E_*E. coli* K-12 MG1655 | Derived from gDNA, with appended tags |

Table 7 contains the sequences of single polypromoter bacterial expression plasmids encoding all five subunit proteins together with the crRNA from a single bacterial expression plasmid. In this design, each gene is separated from the other genes it flanks upstream and downstream with a transcriptional promoter and terminator. Additional sequences can be introduced that encode an affinity tag and/or protease recognition tag, as well as a fusion to a nuclease protein, in order to generate a Cascade-nuclease fusion for gene editing.

TABLE 7

Vectors for Production of Cascade Effector Complexes

| SEQ ID NO: | Description | Effector complex species of origin | Type of sequence |
|---|---|---|---|
| SEQ ID NO: 363 | Polypromoter, Cas5_Cas3_ Cse2_Cas7_ Cas6_Cas8_ CRISPR(J3) | I-E_*E. coli* K-12 MG1655 | Derived from gDNA, with appended tags |
| SEQ ID NO: 364 | Polypromoter, Cas5_Cas3_ Cse2_Cas7_ CRISPR(J3)_ Cas6_Cas8 | I-E_*E. coli* K-12 MG1655 | Derived from gDNA, with appended tags |
| SEQ ID NO: 365 | Polypromoter (EcoCO), CRISPR(J3/L3)_ Cse2_Cas7_ Cas5_Cas8_Cas6 | I-E_*E. coli* K-12 MG1655 | *E. coli* codon-optimized DNA gene sequences |
| SEQ ID NO: 366 | Polypromoter(EcoCO), CRISPR(J3/L3)_ Cse2_Cas7_ Cas5_Cas8_ FokI-30aa-Cas6 | I-E_*E. coli* K-12 MG1655 | *E. coli* codon-optimized DNA gene sequences |
| SEQ ID NO: 367 | Polypromoter(EcoCO), CRISPR(J3/L3)_ Cse2_Cas7_ Cas5_Cas6_ FokI-30aa-Cas8 | I-E_*E. coli* K-12 MG1655 | *E. coli* codon-optimized DNA gene sequences |

Additional bacterial expression plasmids can be designed encoding homologous Cascade complexes from other Type I subtypes and other bacterial or archaeal organisms based on the design criteria herein. Such expression plasmids can be designed with gDNA sequences for the Cascade genes, or they can be designed with gene sequences that have been codon-optimized for expression in *E. coli* or other bacterial strains.

In order to express Cascade or effectors fusions to Cascade in mammalian cells, such as human cells, eukaryotic expression plasmid vectors were designed to enable expression of the relevant proteins and RNA components by eukaryotic transcription and translation machinery. In one embodiment, Cascade can be generated in mammalian cells by encoding each of the protein components on a separate expression vector driven by a eukaryotic promoter (e.g., a cytomegalovirus (CMV) promoter), and encoding the crRNA on a separate expression vector driving by an RNA polymerase III promoter (e.g., the human U6 promoter). The CRISPR RNA can be encoded with a minimal CRISPR array containing at least two repeats flanking one or more spacer sequences that function as the guide portion of the mature crRNA. The construct generating CRISPR RNA can be designed with additional sequences flanking the outermost repeats in the minimal array. Processing of the precursor CRISPR RNA is enabled by the RNA processing subunit of the Cascade complex (Cas6 subunit protein), which can be expressed from a separate plasmid.

Table 8 contains the sequences of individual eukaryotic expression plasmids for each protein of the *E. coli* Type I-E Cascade complex. Cas8 subunit can be fused to additional effector nuclease domains, such as the FokI nuclease (Example 1, Example 3A, Example 3B, and Example 3C). Table 8 also contains the sequences of expression plasmids for the crRNA component of Cascade, encoding two separate crRNAs, whereby three repeat sequences flank two spacer spacers. Each of the protein-coding genes can be appended to polynucleotide sequences that append nuclear localization signals (NLS), affinity tags, and linker sequences connecting those tags. Other fusions to any of the Cascade subunit proteins can be encoded by additional polynucleotide sequences that typically are appended to either the 5' or 3' coding sequence, including additional polynucleotide sequences that encode amino acid linkers connecting to the Cascade subunit protein to additional polypeptide sequences of interest. Examples of candidate fusions proteins are described herein.

TABLE 8

Vectors for Production of Cascade Effector Complexes

| SEQ ID NO: | Description | Effector complex species of origin | Type of sequence |
|---|---|---|---|
| SEQ ID NO: 368 | Cas8, HsCO | I-E_*E. coli* K-12 MG1655 | *H. sapiens* codon-optimized DNA gene sequence |
| SEQ ID NO: 369 | NLS-Cas8, HsCO | I-E_*E. coli* K-12 MG1655 | *H. sapiens* codon-optimized DNA gene sequence |
| SEQ ID NO: 370 | NLS-HA-FokI-30aa-Cas8, HsCO | I-E_*E. coli* K-12 MG1655 | *H. sapiens* codon-optimized DNA gene sequence |
| SEQ ID NO: 371 | NLS-Cse2, HsCO | I-E_*E. coli* K-12 MG1655 | *H. sapiens* codon-optimized DNA gene sequence |
| SEQ ID NO: 372 | NLS-Cas7, HsCO | I-E_*E. coli* K-12 MG1655 | *H. sapiens* codon-optimized DNA gene sequence |
| SEQ ID NO: 373 | Cas5, HsCO | I-E_*E. coli* K-12 MG1655 | *H. sapiens* codon-optimized DNA gene sequence |
| SEQ ID NO: 374 | NLS-Cas5, HsCO | I-E_*E. coli* K-12 MG1655 | *H. sapiens* codon-optimized DNA gene sequence |
| SEQ ID NO: 375 | Cas6, HsCO | I-E_*E. coli* K-12 MG1655 | *H. sapiens* codon-optimized DNA gene sequence |
| SEQ ID NO: 376 | NLS-Cas6, HsCO | I-E_*E. coli* K-12 MG1655 | *H. sapiens* codon-optimized DNA gene sequence |
| SEQ ID NO: 377 | NLS-V5-FokI-30aa-Cas8, HsCO | I-E_*E. coli* K-12 MG1655 | *H. sapiens* codon-optimized DNA gene sequence |
| SEQ ID NO: 378 | Cas3-NLS, HsCO | I-E_*E. coli* K-12 MG1655 | *H. sapiens* codon-optimized DNA gene sequence |
| SEQ ID NO: 379 | CRISPR(Hsa07) | I-E_*E. coli* K-12 MG1655 | *H. sapiens* codon-optimized DNA gene sequence |

In order to express components of the Cascade complex on fewer expression vectors, polycistronic expression vectors can be constructed, whereby a single promoter (e.g., a CMV promoter) drives expression of multiple coding sequence simultaneously that are separated by a *Thosea asigna* virus 2A sequence. 2A viral peptide sequences induce ribosomal skipping, enabling multiple protein-coding genes to be concatenated within a single polycistronic construct for expression in eukaryotic cells. Thus, polycistronic vectors can be designed that encode four or five protein subunits of the Cascade complex on a single transcript driven by a single promoter. Table 9 contains the sequences of eukaryotic polycistronic expression plasmids that can be combined with a CRISPR RNA expression plasmid to produce functional Cascade in mammalian cells.

TABLE 9

Vectors for Production of Cascade Effector Complexes

| SEQ ID NO: | Description | Effector complex species of origin | Type of sequence |
|---|---|---|---|
| SEQ ID NO: 380 | Polycistronic(HsCO), NLS-Cas7_NLS-Cse2_NLS-Cas5_NLS-Cas6 | I-E_*E. coli* K-12 MG1655 | *H. sapiens* codon-optimized DNA gene sequence |
| SEQ ID NO: 381 | Polycistronic(HsCO), NLS-Cas7_NLS-Cse2_NLS-Cas5_NLS-Cas6_NLS-Cas8 | I-E_*E. coli* K-12 MG1655 | *H. sapiens* codon-optimized DNA gene sequence |
| SEQ ID NO: 382 | Polycistronic(HsCO), NLS-Cas7_NLS-Cse2_NLS-Cas5_NLS-Cas6_NLS-FokI-30aa-Cas8 | I-E_*E. coli* K-12 MG1655 | *H. sapiens* codon-optimized DNA gene sequence |
| SEQ ID NO: 383 | Polycistronic(HsCO), NLS-Cas7_NLS-Cse2_NLS-Cas5_NLS-Cas6_NLS-FokI-30aa-Cas8, no epitope tags | I-E_*E. coli* K-12 MG1655 | *H. sapiens* codon-optimized DNA gene sequence |
| SEQ ID NO: 384 | Polycistronic(HsCO), NLS-Cas7_NLS-Cse2_NLS-Cas5_NLS-FokI-30aa-Cas6_NLS-Cas8, no epitope tags | I-E_*E. coli* K-12 MG1655 | *H. sapiens* codon-optimized DNA gene sequence |

In some embodiments, the CRISPR RNA is encoded within the 3' untranslated region (UTR) of a protein-coding gene, the expression of which is driven by an RNA polymerase II promoter (e.g., CMV promoter) to produce a transcript. In such embodiments, the minimal CRISPR array is designed to exist downstream of a protein coding gene such as Cas6, Cas7, or a reporter gene (e.g., an enhanced green fluorescent protein, eGFP), and is separated from the protein coding sequence by a MALAT1 triplex sequence that has previously been shown to confer stability to the upstream transcript. The minimal CRISPR array is processed by the RNA processing subunit of Cascade (typically expressed using a different plasmid), an endonuclease that cleaves the minimal CRISPR array, a break is introduced into the transcript, and the triplex sequence protects the 3' end of the upstream protein-coding gene from premature exonucleolytic degradation. Table 10 contains sequences of three polynucleotide sequences, whereby the CRISPR array is cloned downstream of either Cas6, Cas7, or eGFP, and expression of the entire fusion sequence is driven by a CMV promoter.

TABLE 10

Vectors for Production of Minimal CRISPR Arrays

| SEQ ID NO: | Description | Effector complex species of origin | Type of sequence |
|---|---|---|---|
| SEQ ID NO: 385 | eGFP_MALAT1-triplex_CRISPR (Hsa07) | I-E_*E. coli* K-12 MG1655 | *H. sapiens* codon-optimized DNA gene sequence |
| SEQ ID NO: 386 | NLS-Cas7_MALAT1-triplex_CRISPR (Hsa07) | I-E_*E. coli* K-12 MG1655 | *H. sapiens* codon-optimized DNA gene sequence |
| SEQ ID NO:387 | NLS-Cas6_MALAT1-triplex_CRISPR (Hsa07) | I-E_*E. coli* K-12 MG1655 | *H. sapiens* codon-optimized DNA gene sequence |

In some embodiments, the CRISPR RNA array is encoded on the same vector as the polycistronic construct driving expression of the five5 Cascade subunit proteins; the combination of these two elements generates an all-in-one vector that produces all functional subunits (both protein and RNA) of the Cascade complex, together with any nuclease or effector domains fused to one of the Cascade subunits. Table 11 contains two representative sequences of these all-in-one polynucleotide sequences that encode all the respective components to produce functional FokI-Cascade RNPs in mammalian cells.

TABLE 11

Vectors for Production of Cascade Effector Complexes

| SEQ ID NO: | Description | Effector complex species of origin | Type of sequence |
|---|---|---|---|
| SEQ ID NO: 388 | hU6_CRISPR (Hsa07)_F, CMV_NLS-Cas7_NLS-Cse2_NLS-Cas5_NLS-Cas6_NLS-FokI-30aa-Cas8 | I-E_*E. coli* K-12 MG1655 | *H. sapiens* codon-optimized DNA gene sequence |
| SEQ ID NO: 389 | hU6_CRISPR (Hsa07)_R, CMV_NLS-Cas7_NLS-Cse2_NLS-Cas5_NLS-Cas6_NLS-FokI-30aa-Cas8 | I-E_*E. coli* K-12 MG1655 | *H. sapiens* codon-optimized DNA gene sequence |

Example 3A, Example 3B, and Example 3C describe expression systems using separate plasmids expressing each Cascade subunit protein and minimal CRISPR array, expression systems wherein multiple Cascade subunit protein coding sequences are expressed from a single promoter, and an expression system wherein a single-plasmid Cascade expression system was constructed to express the entire cas8-cse2-cas7-cas5-cas6 operon and a minimal CRISPR array for use in mammalian cells.

One of ordinary skill in the art following the guidance of the present Specification can design additional mammalian expression vectors encoding other Cascade complexes analogously to the examples provided the *E. coli* Type I-E Cascade complex.

In a fourth aspect, the present invention relates to production of engineered Type I CRISPR-Cas effector complexes by introduction of plasmids encoding one or more components of the engineered Type I CRISPR-Cas effector complexes into host cells. Transformed host cells (or recombinant cells) or the progeny of cells that have been transformed or transfected using recombinant DNA techniques can comprise one or more nucleic acid sequences encoding one or more component of an engineered Type I CRISPR-Cas effector complex. Methods of introducing polynucleotides (e.g., an expression vector) into host cells are known in the art and are typically selected based on the kind of host cell. Such methods include, for example, viral or bacteriophage infection, transfection, conjugation, electroporation, calcium phosphate precipitation, polyethyleneimine-mediated transfection, DEAE-dextran mediated transfection, protoplast fusion, lipofection, liposome-mediated transfection, particle gun technology, microprojectile bombardment, direct microinjection, and nanoparticle-mediated delivery. In one embodiment of the present invention, polynucleotides encoding components of engineered Type I CRISPR-Cas effector complexes are introduced into bacterial cells (e.g., E. coli).

Example 4A and Example 4B describe a method for introduction and expression of Cas8 protein coding sequences, as well as coding sequences for components of engineered Type I CRISPR-Cas effector complexes for bacterial production of such complexes using E. coli expression systems.

A variety of exemplary host cells disclosed herein can be used to produce recombinant cells using an engineered Cascade effector complex. Such host cells include, but are not limited to, a plant cell, a yeast cell, a bacterial cell, an insect cell, an algal cell, and a mammalian cell.

For ease of discussion, "transfection" is used below to refer to any method of introducing polynucleotides into a host cell.

In some embodiments, a host cell is transiently or non-transiently transfected with nucleic acid sequences encoding one or more component of a Type I CRISPR-Cas effector complex. In some embodiments, a cell is transfected as it naturally occurs in a subject. In some embodiments, a cell that is transfected is first removed from a subject, e.g., a primary cell or progenitor cell. In some embodiments, the primary cell or progenitor cell is cultured and/or is returned after ex vivo transfection to the same subject or to a different subject.

Figure 35:
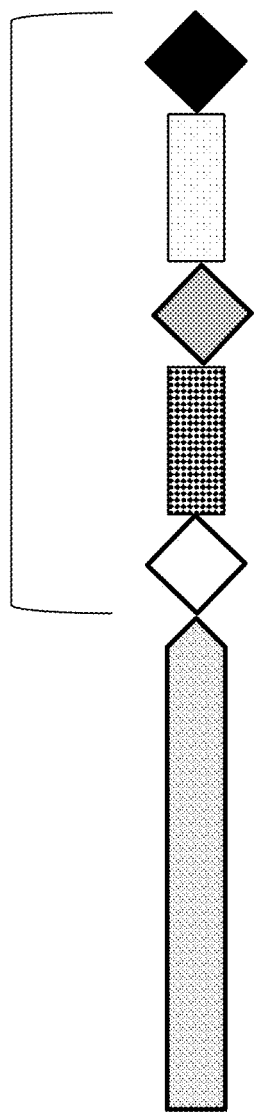
FIG. 35 illustrates an example of a minimal CRISPR array containing paired guide RNAs (gRNAs).

Expression and purification of engineered Type I CRISPR-Cas effector complexes is labor intensive, so to facilitate screening across a large number of guide polynucleotide or effector complex variants, a higher throughput plasmid-based delivery system was designed. Each of the five Cas genes was human codon-optimized and cloned into a CMV-driven expression plasmid as an N-terminal NLS fusion, and a minimal CRISPR array containing paired gRNAs targeting the TRAJ27 exon of the T cell receptor alpha locus (UCSC genome browser, hg38) was cloned into a sixth plasmid downstream of a human U6 promoter (Example 3A; FIG. 35). In FIG. 35, the order of the elements from left to right is as follows: hu6 promoter, grey rectangle with diamond end; repeat 1, open diamond, (white); spacer 1, grey waffle rectangle; repeat 2, grey diamond; spacer 2, grey stipple rectangle; and repeat 3, black diamond. In FIG. 35, the bracket illustrates the region encoding two gRNAs. In some embodiments, the two guide RNAs can be the same (e.g., target the same nucleic acid target sequence), and in other embodiments the two guide RNAs can be different (e.g., target two different nucleic acid target sequences).

gRNA processing in most Type I systems is naturally catalyzed by the Cas6 ribonuclease present in Cascade (see, e.g., Brouns, S. J., et al., Science 321:960-964 (2008); Hochstrasser, M., et al., Trends Biochem. Sci. 40:58-66 (2015), obviating the need for multiple promoters with the paired gRNA approach set forth herein. Accordingly, one embodiment of the present invention comprises vectors comprising paired guide polynucleotides operably linked to regulatory elements to provide expression of the guide polynucleotides (e.g., gRNAs). Six-plasmid co-transfection yielded up to ~3% editing at the TRAJ27 locus, and removal of any one component abrogated genome editing, with the sole exception of Cas11, which the E. coli Cascade effector complex does not absolutely require for DNA binding (see, e.g., Westra, E., et al., RNA Biol. 9:1134-1138 (2012)).

Figure 15A:
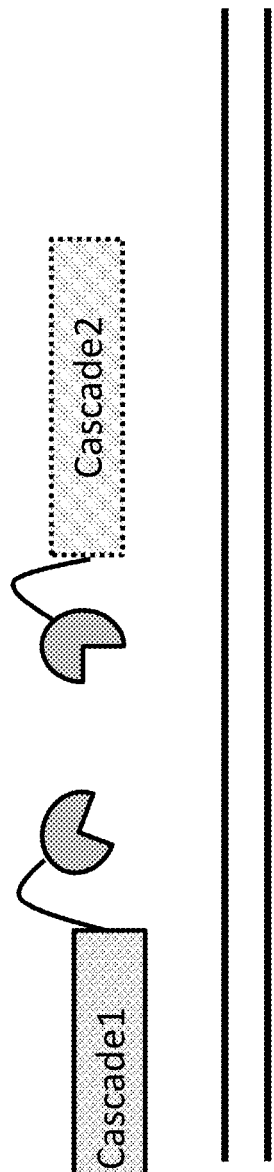
Figure 15B:
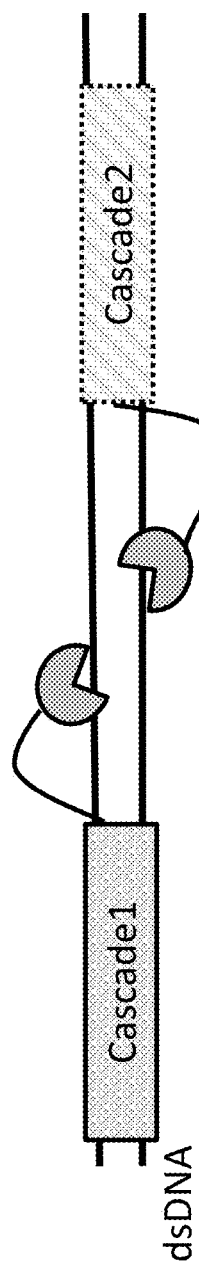
Figure 15C:
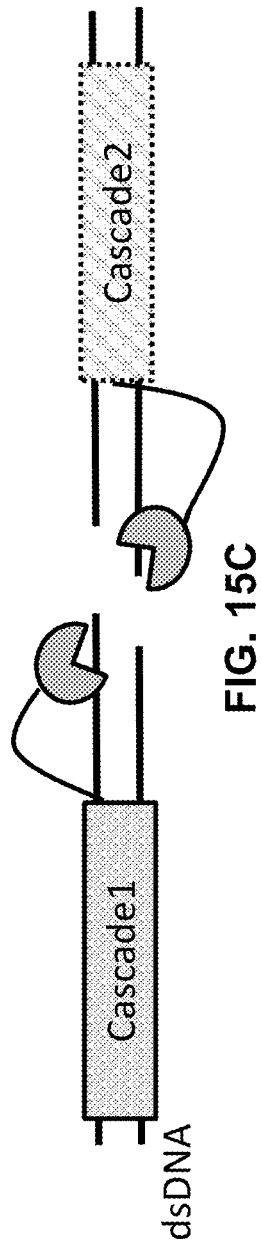

In another embodiment of the present invention, minimal CRISPR arrays, typically comprising two guide sequences, are introduced into cells or biochemical reactions as DNA templates. The DNA templates are produced by PCR amplification (e.g., FIG. 42A; Example 20A). Such minimal CRISPR arrays can be introduced into cells with one or more plasmids encoding the Cascade complex protein components. In some embodiments, minimal CRISPR arrays and vectors comprising paired guide polynucleotides can both be introduced into a cell or biochemical reaction. In methods using two Cascade RNP complexes (e.g., methods of binding a nucleic acid target sequence or methods of cutting a nucleic acid target sequence; see, e.g., FIG. 15A, FIG. 15B, FIG. 15C), minimal CRISPR arrays can encode two different guides. Accordingly, in some embodiments the two guide RNAs can be different (e.g., target two different nucleic acid target sequences). In methods using a single Cascade RNP complex (e.g., when using one Type I CRISPR-Cas effector complex associated with a mCas3 protein or a Type I CRISPR-Cas effector complex wherein a Cas3 fusion protein associates with the complex; e.g., see, e.g., FIGS. 16A, 17B, 17C, FIG. 21A, FIG. 21B, FIG. 21C, FIG. 21D), minimal CRISPR arrays can encode two copies of the same guide sequence. Accordingly, in some embodiments, the two guide RNAs can be the same (e.g., target the same nucleic acid target sequence).

In yet another embodiment, polynucleotides encoding guide sequences that further comprise sequences and structures recognized by Cas6 protein for the endonucleolytic processing of crRNA precursors to mature guide RNAs can be introduced into cells or biochemical reactions. In other embodiments, mature guide polynucleotides that do not require processing can be used in assembly of Cascade complexes. Such mature guides can comprise sequence modifications (e.g., phosphorothioate linkages at the 5' and/or 3' ends to help protect the guide from nuclease digestion, such as by RNases). Additional guide modifications include those described herein for nucleotide sequences (e.g., nucleotide analogs, etc.).

Example 9A, Example 9B, Example 9C, and Example 9D illustrate the design and delivery of E. coli Type I-E Cascade complexes comprising FokI fusion proteins to facilitate genome editing in human cells. Example 9B describes the delivery of plasmid vectors expressing Cascade complex components into eukaryotic cells. In a fifth aspect, the present invention relates to the purification of engineered Type I CRISPR-Cas effector complexes from cells and uses of such complexes. Engineered Type I CRISPR-Cas effector complexes are produced in a host cell. The engineered Type I CRISPR-Cas effector complexes (in this case Cascade RNP complexes) are purified from cell lysates.

Example 5A and Example 5B describe purification of E. coli Type I-E Cascade RNP complexes produced by overexpression in bacteria as described in Example 4B. The method uses immobilized metal affinity chromatography followed by size exclusion chromatography (SEC). Example 5A and Example 5B describe methods that can be used to assess the quality of purified Cascade RNP products.

Examples are presented illustrating the purification of Cas8, Cas7, Cas6, Cas5, and Cse2 Cascade RNP complexes, Cascade complexes comprising Cas7, Cas6, Cas5, and Cse2 proteins, and FokI-Cas8 fusion proteins.

The purified, engineered Type I CRISPR-Cas effector complexes can also be used directly in biochemical assays (e.g., binding and/or cleavage assays). Example 6A, Example 6B, and Example 6C describe production of dsDNA target sequences for use in in vitro DNA binding or cleavage assays. Example 6 describes three methods to produce target sequences, including annealing of synthetic ssDNA oligonucleotides, PCR amplification of selected nucleic acid target sequences from gDNA, as well as cloning of nucleic acid target sequences into bacterial plasmids. The dsDNA target sequences were used in Cascade binding or cleavage assays.

The site-specific binding of and/or cutting by one or more engineered Type I CRISPR-Cas effector complexes can be confirmed, if necessary, using an electrophoretic mobility shift assay (see, e.g., Garner, M., et al., Nucleic Acids Res. 9:3047-3060 (1981); Fried, M., et al., Nucleic Acids Res. 9:6505-6525 (1981); Fried, M., Electrophoresis 10:366-376 (1989); Fillebeen, C., et al., J. Vis. Exp. (94), e52230, doi:10.3791/52230 (2014)), or the biochemical cleavage assay described in Example 7.

The data presented in Example 7 demonstrate that engineered Type I CRISPR-Cas effector complexes can exhibit nearly quantitative DNA cleavage, as evidenced by conversion of a supercoiled, circular plasmid substrate into a cleaved, linear form. After demonstrating robust biochemical activity with engineered Type I CRISPR-Cas effector complexes (e.g., comprising FokI-Cascade component fusion proteins), genome editing in cells was performed.

Example 8A, Example 8B, Example 8C, and Example 8D illustrate the design and delivery of *E. coli* Type I-E Cascade complexes comprising Cas subunit protein-FokI fusion proteins to human cells. The data in Example 8D demonstrate delivery of pre-assembled Cascade RNPs into target cells and effective genome editing in human cells.

The purified, engineered Type I CRISPR-Cas effector complexes can be directly introduced into cells. Methods to introduce the components into a cell include electroporation, lipofection, particle gun technology, and microprojectile bombardment.

Figure 36A:
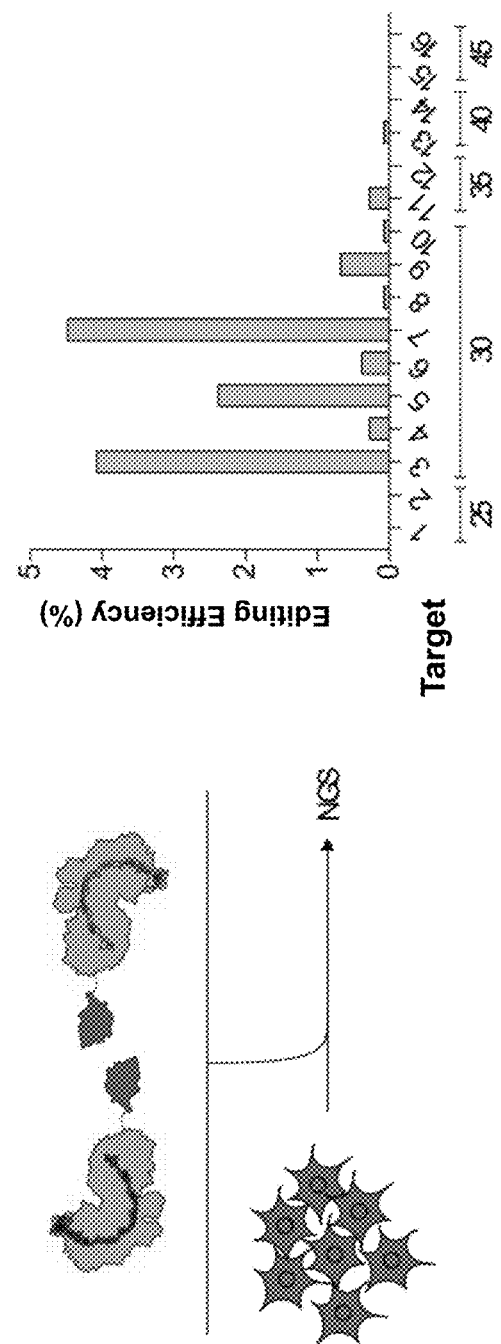
FIG. 36A, FIG. 36B, FIG. 36C, and FIG. 36D present data related to genome editing in human cells via RNP and plasmid-based delivery of engineered Type I CRISPR-Cas complexes.

FIG. 36A, FIG. 36B, FIG. 36C, and FIG. 36D provide comparative data for genome editing in human cells using engineered Cascade-RNP complexes and plasmid-based delivery of engineered Type I CRISPR-Cas complexes. In FIG. 36A-D, FIG. 36A, HEK293 cells were transfected with purified RNPs followed by next-generation sequencing (NGS) analysis of edited sites. As is shown in FIG. 36A (RNP Transfection), FokI-Cascade RNP complexes (FIG. 36A, represented on the left side of the figure above the straight line) targeting two adjacent loci were nucleofected into HEK293 cells (FIG. 36A, star-shaped, grey, to the left of the figure) to induce DNA cleavage and genome editing. Editing efficiencies at 16 unique genomic target sites (see Example 6C, Table 31, Human Dual Hsa1-16) were calculated (n=1). TRAC is the constant region of the T cell receptor. When T cell receptors are generated, they include splice junctions (i.e., "variable" region and "joining" region). Some of the TRAC guides described herein target joining regions (e.g., TRAJ27). Interspacer distances for each target are shown below the graph (FIG. 36A, left to right, 25, 30, 35, 40, 45 base pairs (bp)). In FIG. 36A, the vertical axis is percent editing efficiency (FIG. 36A, Editing Efficiency (%)), the horizontal axis represents targets 1 to 16, and below the horizontal axis are brackets indicating the interspacer length in base pairs (bp).

Figure 36B:
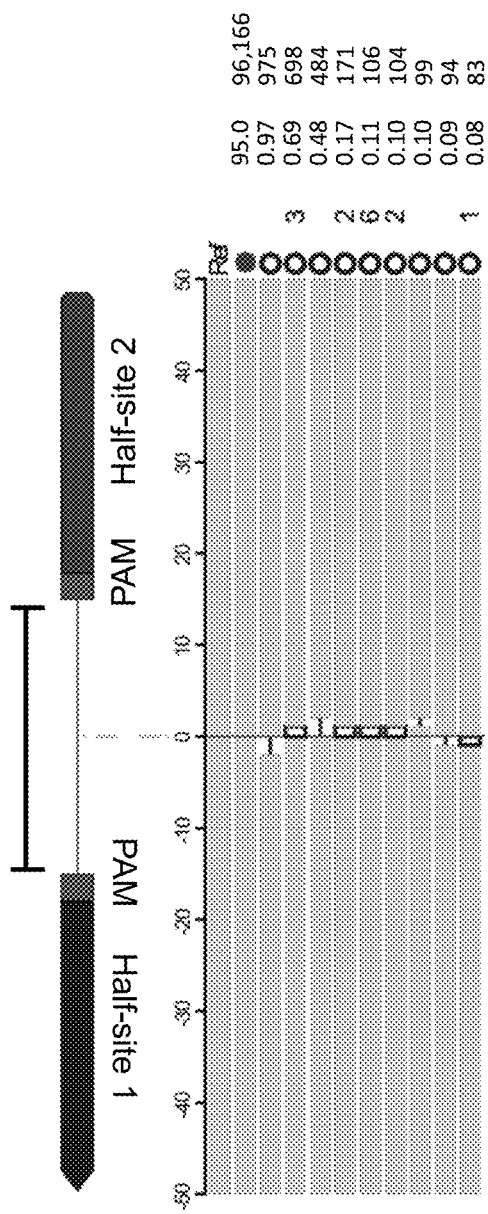

FIG. 36B provides representative DNA repair outcomes for Target 7 in FIG. 36A. In FIG. 36B, the relative locations of the half-sites targeted by the paired gRNAs are shown at the top of the figure, with their associated PAM sites. The interspacer distance is illustrated by the top line. In the graph, the expected cleavage site (FIG. 36B, position "0" shown as vertical black mid-line) and bp distances (−50 to 50) are indicated at the top. Each horizontal grey line represents a different class of sequenced reads that were observed at the targeted locus. Indicators for these lines are as follows: grey area=sequence match; horizontal black line=deletion; and open box=insertion. A circle is located to the right of the graph by each line: the black circle is a wild-type read; and the open white circles are mutant reads. The expected wild-type read is illustrated in the first grey bar ("Ref"; i.e., the reference sequence). The wild-type read is illustrated in the second grey bar (the second grey bar; FIG. 36B, black circle). The next 11 lines illustrate mutant reads (FIG. 36B, open circles). Insertion lengths, given in number of base pairs, are shown in the column to the right of the circles. The total percent of reads is shown in the next column to the right, and the total reads are presented in the last column to the right.

Figure 36C:
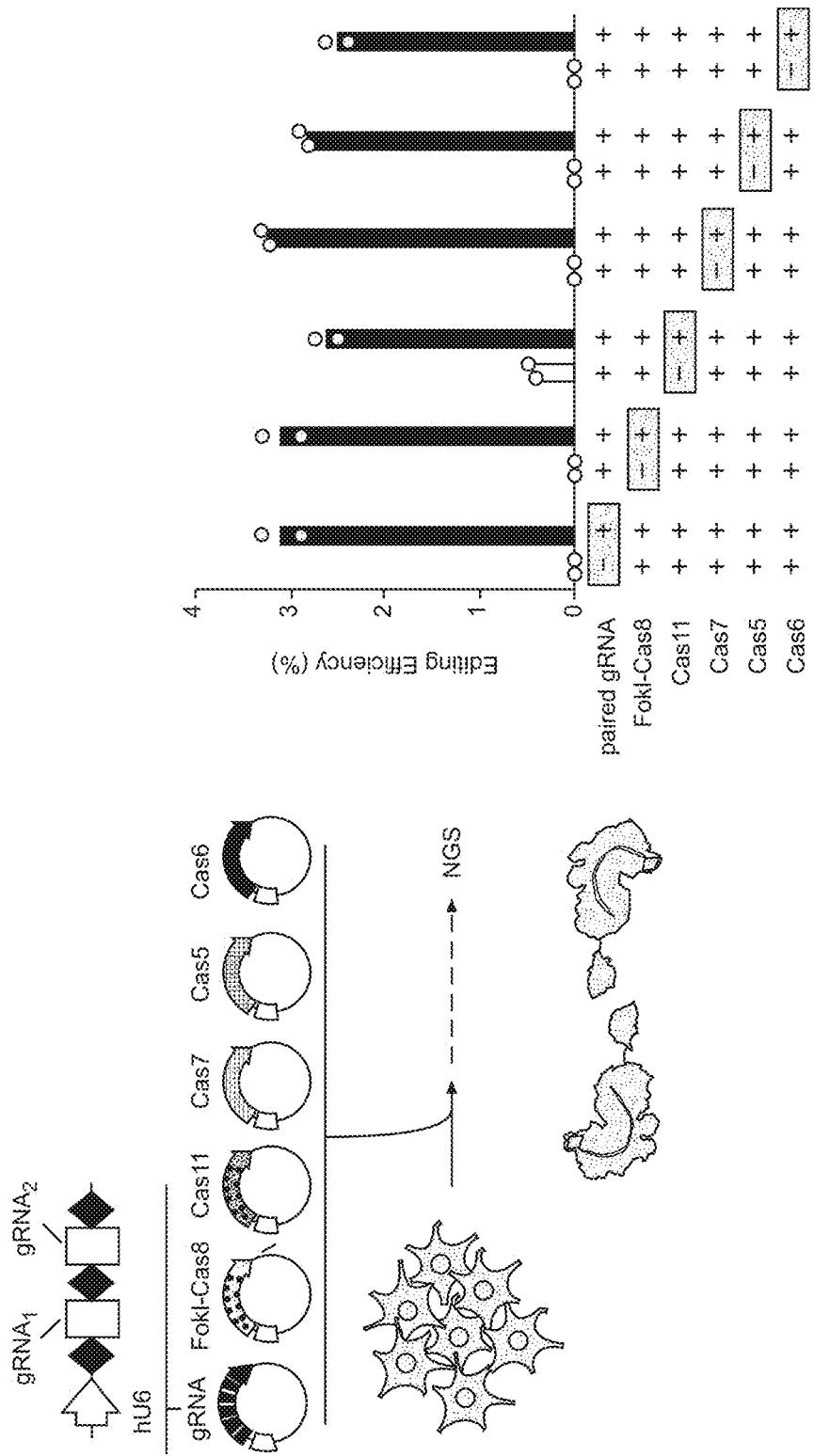

As shown in FIG. 36C (6-plasmid transfection system), HEK293 cells (FIG. 36C, star-shaped, grey, to the left of the figure) were transfected with six plasmids, five plasmids encoding a Cas proteins (FIG. 36C, plasmids indicated as FokI-Cas8, Cas11, Cas7, Cas5, and Cas6), and one plasmid encoding the paired gRNAs were under the control of a CMV and human U6 (hU6) promoter (FIG. 36C, gRNA), followed by NGS analysis of edited sites. Illustrations of the FokI-Cascade RNP complexes are below the dashed line. Editing efficiencies at Target 7 from FIG. 36A were calculated (n=2) (FIG. 36A, black bars in the graph), and plasmid mixtures lacking single components (FIG. 36C, below horizontal axis, grey boxes containing −/+) were included as controls (FIG. 36C, open bars in the graph).

Figure 36D:
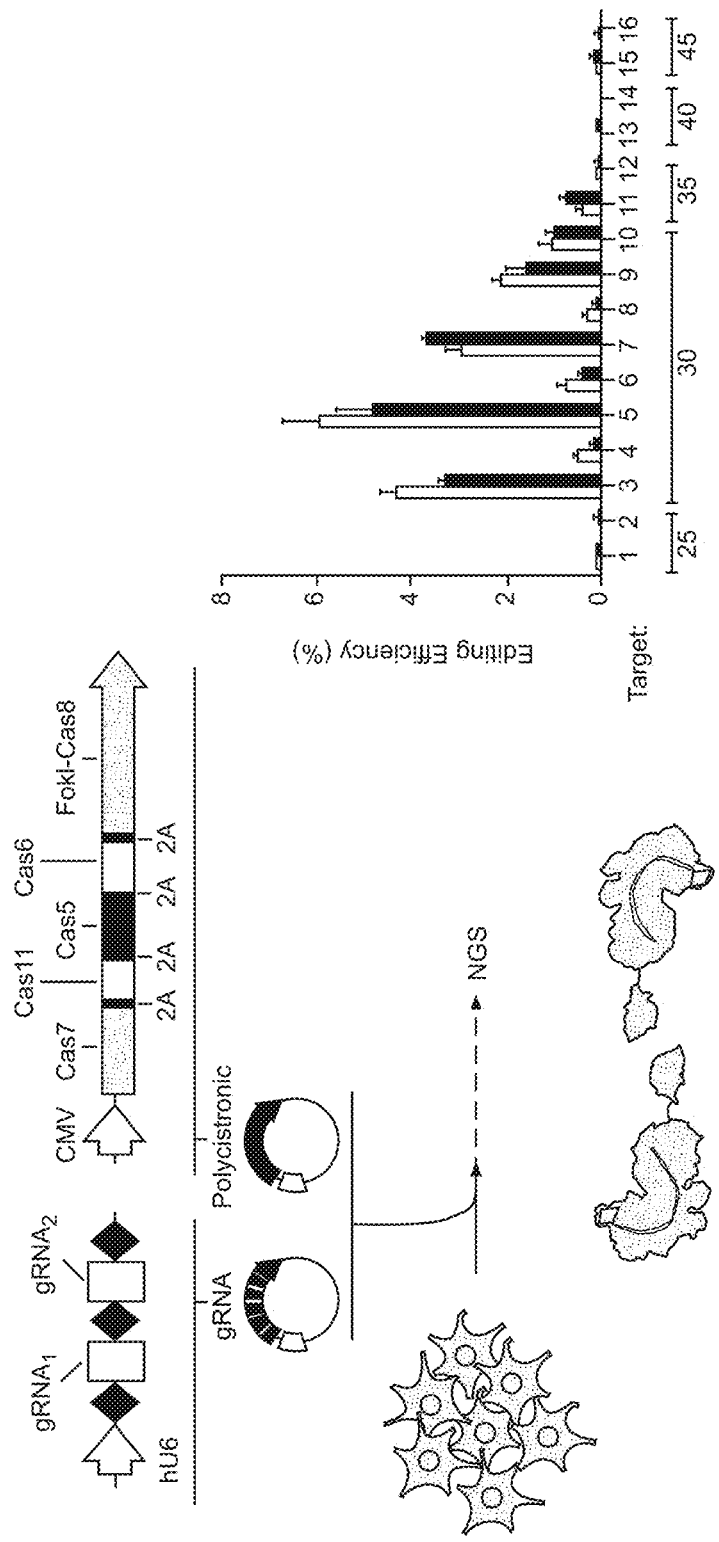

As shown in FIG. 36D (2-plasmid transfection system), HEK293 cells (FIG. 36D, star-shaped, grey, to the left of the figure) were transfected with a paired gRNA expression plasmid (FIG. 36D, gRNA plasmid) and a polycistronic expression plasmid encoding all five proteins separated by T2A "ribosome skipping" sequences peptides (FIG. 36D, CMV-Cas7-2A-Cas11-2A-Cas5-2A-Cas6-2A-FokI-Cas8), followed by NGS analysis of edited sites. Illustrations of the FokI-Cascade RNP complexes are below the dashed line. Editing efficiencies at the 16 targets shown in FIG. 36A were calculated for both the 2-plasmid system transfections (FIG. 36D, open bars) and the 6-plasmid system transfections from FIG. 37C (n=3) (FIG. 36D, black bars). In FIG. 36D, the vertical axis is percent editing efficiency ("Editing Efficiency (%)), the horizontal axis represents targets 1 to 16, and below the horizontal axis are brackets indicating the interspacer length in base pairs (bp) (FIG. 36D, left to right, 25, 30, 35, 40, 45 bp).

Experiments were carried out by nucleofecting HEK293 cells with purified Cascade-RNPs containing nuclear localization signal sequences on FokI and Cas6. Up to ~4% editing efficiency was observed, as evidenced by next-generation sequencing of PCR amplicons obtained from gDNA and, among the 16 target sites tested, editing was typically at sites containing 30 bp interspacer lengths (FIG. 36A). Closer inspection of the spectrum of repair outcomes revealed that indels were clustered in the middle of the interspacer (FIG. 36B) consistent with the design of the Type I CRISPR-Cas complexes. Accordingly, in one embodiment of the present invention, the engineered Type I CRISPR-Cas complexes are introduced directly into a cell. For the 6-plasmid delivery experiments (FIG. 36C), plasmid mixtures were assembled containing 420 ng of each plasmid except one, and then either water as a negative control or 700 ng of the missing plasmid was added back subsequent to nucleofection. For the initial FokI-EcoCascade polycistronic 2-plasmid delivery experiments (FIG. 36D), cells were electroporated with 500 ng of each plasmid or 500 ng of paired gRNA expression plasmid and 2.5 μg of polycistronic plasmid (3 μg total for each condition). In one embodiment, all five cas genes were constructed into a single polycistronic expression vector (FIG. 36D) connected in series by T2A "ribosome skipping" sequences (see, e.g., Kim, J., et al., PLoS ONE 6, e18556 (2011); Liu, Z., et al., Sci. Rep. 7:2193 (2017)). Strikingly, co-transfection with the polycistronic plasmid and paired gRNA expression plasmid resulted in editing efficiencies and DNA repair outcomes similar to those observed with both the 6-plasmid method (Example 9A) and direct RNP delivery methods (Example 8A, Example 8B, Example 8C, Example 8D), supporting the conclusion that biochemically active engineered Type I CRISPR-Cas effector complexes were being assembled and trafficked to the nucleus in human cells. Collectively, these experiments validated a greatly simplified expression system to reconstitute an elaborate, 11-subunit RNA-guided nuclease in eukaryotic cells with just two molecular components that are similar in size to the widely used Cas9 and sgRNA plasmids.

The data for engineered Type I CRISPR-Cas complexes (*E. coli* (EcoCascade, *Pseudomonas* sp. S-6-2 (PseCascade), and *Streptococcus thermophilus* (SthCascade)) suggested that most target sites would be unique since they must include both half-sites, the requisite interspacer distance, and permissive PAMs. Engineered Cascade homologs from EcoCascade, PseCascade, and SthCascade were selected for more detailed characterization.

Figure 37D:
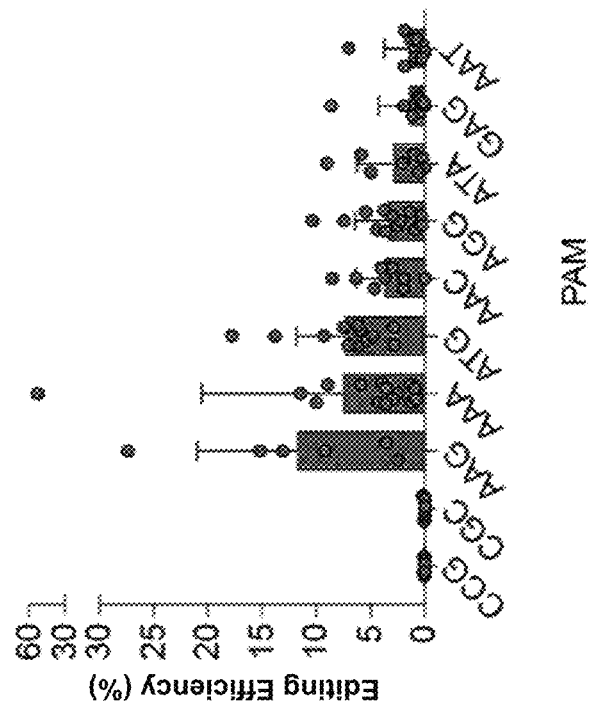

FIG. 37A, FIG. 37B, FIG. 37C, and FIG. 37D, illustrate editing efficiency as related to the FokI linker, interspacer length, and Cascade homolog. FIG. 37A, FokI-EcoCascade editing efficiency is shown as a function of FokI-Cas8 linker length (FIG. 37A, open circles, low line 10 aa; open circle upper graph line, 20 aa; black circles, 17 aa; and grey circles, 30 aa linker lengths) and interspacer distance. In FIG. 37A the vertical axis is editing efficiency (%), and the horizontal axis is interspacer distance in bp. Each data point represents the average of 3-4 unique target sites.

FIG. 37B provides FokI-Cascade nucleases with 30-aa linkers. FokI-Cas8 linkers were generated for 12 Type I-E Cascade variants and tested for genome editing at 4-7 target sites. Each data point represents a single genomic site, and bars show the mean and standard deviation (s.d.) across sites. Targets contained either AAG (FIG. 37B, grey bars) or GAA (FIG. 37B, white bars) PAM sequences and 30 bp interspacer distances, wherein the species are on the horizontal axis as follows: Eco, *E. coli*; Pse, *Pseudomonas* sp. S-6-2; Sen, *Salmonella enterica*; Geo, *Geothermobacter* sp. EPR-M; Mar, *Methanocella arvoryzae*; Ahe, *Atlantibacter hermannii*; Oce, *Oceanicola* sp. HL-35; Pae, *Pseudomonas aeruginosa*; Sth, *Streptococcus thermophilus*; Str, *Streptomyces* sp. S4; Kpn, *Klebsiella pneumoniae*; Lba, *Lachnospiraceae bacterium*.

Figure 37C:
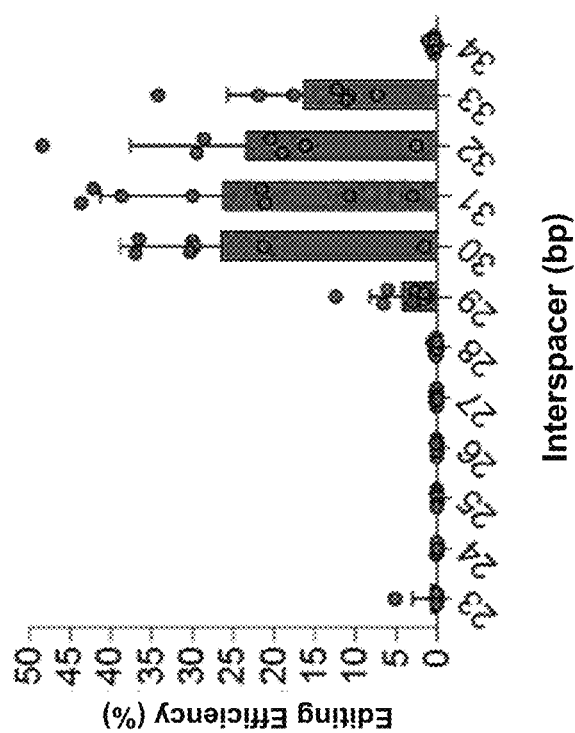

In FIG. 37C, FokI-PseCascade data is presented, wherein the vertical axis is percent editing efficiency (FIG. 37C, Editing Efficiency (%)) and the horizontal axis represents the interspacer length in base pairs (bp). The FokI-Cas8 linker length was 17 amino acids. Each data point represents a single genomic site, and bars show the mean and s.d. across 7-8 sites.

FIG. 37D provides data for FokI-PseCascade editing efficiency as a function of PAM sequence, the vertical axis is percent editing efficiency (FIG. 37D, Editing Efficiency (%)), and the horizontal axis corresponds to PAM sequences (FIG. 37D, left to right, CCG, CGC, AAG, AAA, ATG, AAC, AGG, ATA, GAG, and AAT). Genomic sites contained one AAG PAM and a variable PAM at the second half-site, as shown on the horizontal axis. Each data point represents a single genomic site, and bars show the mean and s.d. across 6-15 sites.

Figure 37E:
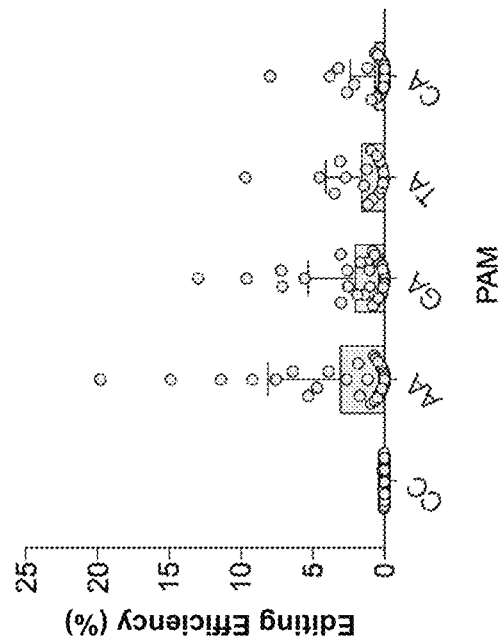

FIG. 37E provides data for FokI-EcoCascade editing efficiency (FIG. 37E, vertical axis, editing efficiency (%)) as a function of PAM sequence. Target sites contained a fixed AAG PAM and a variable PAM at the second half-site, as shown on the horizontal axis (FIG. 37E, left to right, CCG, CGC, AAG, AGG, ATG, GAG, AAA, AAC, ATA, and AAT). Each dot represents a single target site in HEK293 cells and 6-15 sites were tested per PAM (n=1 per site). The bar graph displays the mean and s.d.

Figure 37F:
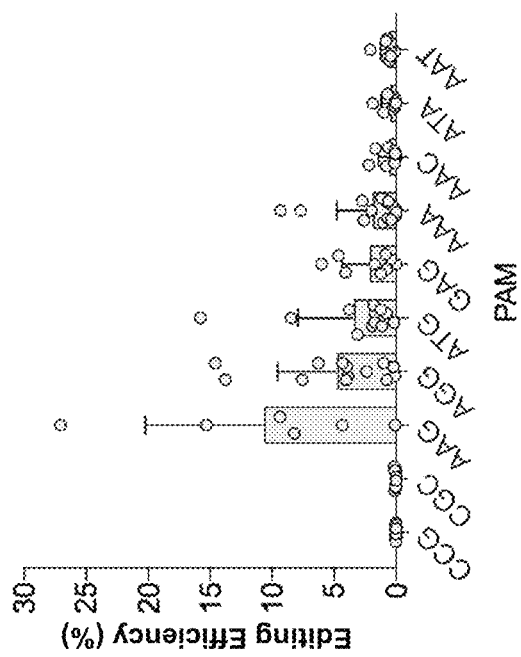

FIG. 37F provides data for FokI-SthCascade efficiency (FIG. 37F, vertical axis, editing efficiency (%)) as a function of PAM sequence. Target sites contained a fixed GAA PAM and a variable PAM at the second half-site, as shown on the horizontal axis (FIG. 37F, left to right, CC, AA, GA, TA, and CA). Each dot represents a single target site in HEK293 cells and 18-33 sites were tested per PAM (n=1 per site). The bar graph displays the mean and s.d.

Figure 37G:
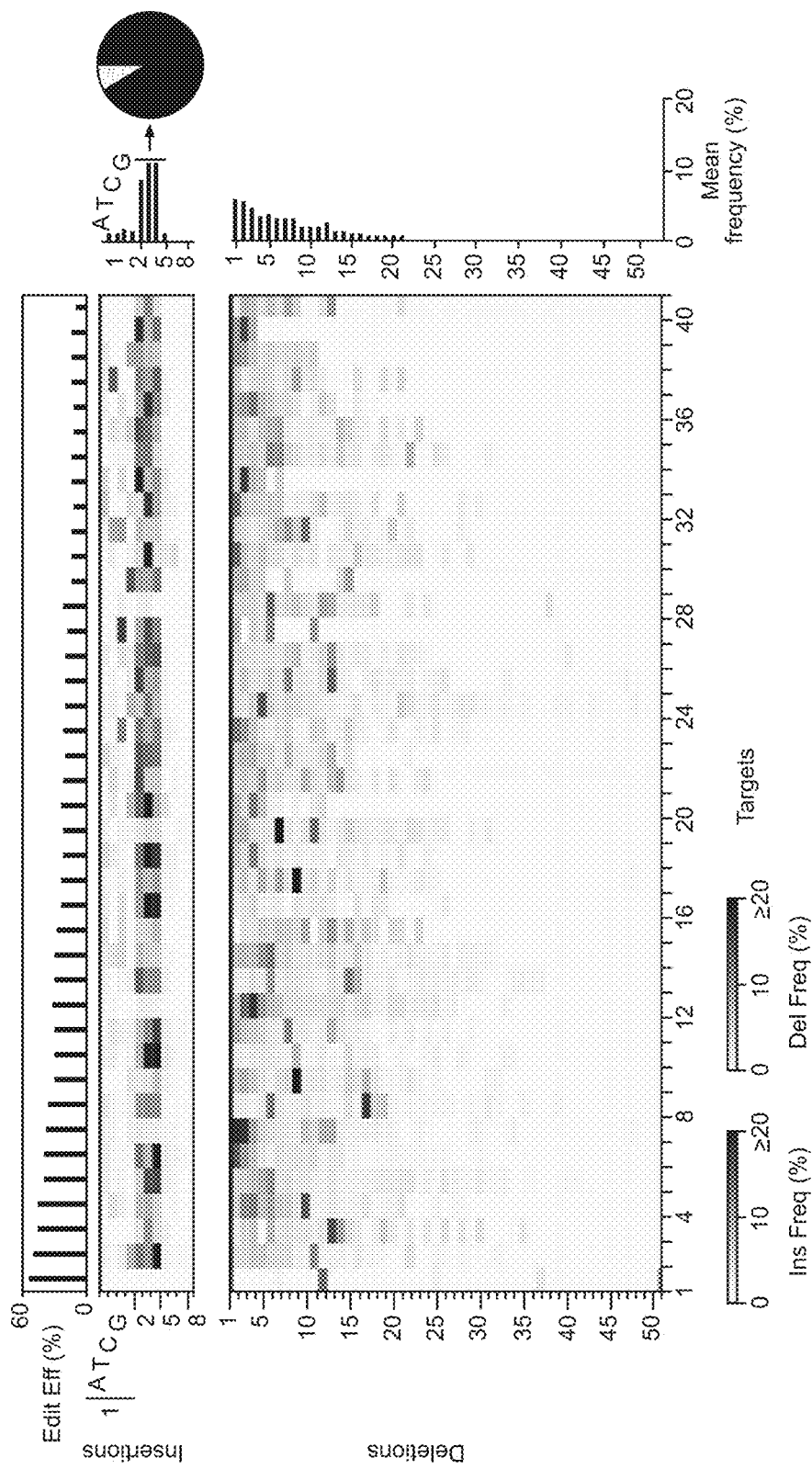

FIG. 37G provides heat maps depicting the indel class frequencies for 40 genomic sites exhibiting high editing efficiencies (10-53%) from FIG. 37C and FIG. 37D. Percent editing efficiency from 0-60 is presented in the bar graph in the top panel. Insertion lengths from 1-8 bp are presented in the heat map presented in the middle panel, and deletions lengths from 1-50 bp are presented in the heat map in the bottom panel. The 40 genomic target sites (FIG. 37G, Targets) are indicated on the horizontal axis (1-40). Single bp insertions are separated by nucleotide identity, and the grey scale intensity scales at the bottom of the figure correspond to insertion frequency percentage (FIG. 37G, Ins Freq (%), scale is 0 to greater than or equal to 20) and deletion frequency percentage (FIG. 37G, Del Freq (%), scale is 0 to greater than or equal to 20). The bar graph to the right displays the mean frequency (FIG. 37G, scale is 0 to 20) of each indel class. The pie chart to the right shows the fraction of 2-4 bp insertions resulting from putative templated repair (FIG. 37G, black area of pie chart), defined here as containing a duplication of sequences adjacent to the cleavage site. "Other" is represented in grey area of pie chart.

The most closely related sites in the human genome for the five most highly edited FokI-PseCascade target sites (~20-48% editing) were investigated, constrained only by a 30-33 bp interspacer requirement. Across all five targets, no sites with <22 mismatches across both half-sites were identified. For FokI-EcoCascade FokI-Cas8 linker type and interspacer distance experiments (FIG. 37A), cells were nucleofected with 2.4 μg of FokI-EcoCascade polycistronic plasmid and ~0.5-3.5 μg of paired gRNA expression plasmid.

For the FokI-Cascade homolog screen (FIG. 37B), cells were nucleofected with 1.5 μg of FokI-Cascade polycistronic plasmid and ~0.4-2.2 μg of paired gRNA expression plasmid. Across homologs, 4-7 sites were targeted, and sites were selected that showed high editing efficiency with FokI-EcoCascade. For the homolog variant FokI-Cas8 linker type and interspacer distance editing experiments (FIG. 37C and FIG. 41A to FIG. 41C), cells were nucleofected with 5 µg of polycistronic plasmid and ~100-400 ng of oligo-templated paired gRNA expression amplicon. For this experiment, gRNA concentrations were not normalized across wells or homolog variants. Additionally, for FIG. 41A to FIG. 41C, cells were nucleofected with, on average, ~1.5× more FokI-PseCascade gRNA than FokI-EcoCascade or FokI-SthCascade gRNA.

Figure 42A:
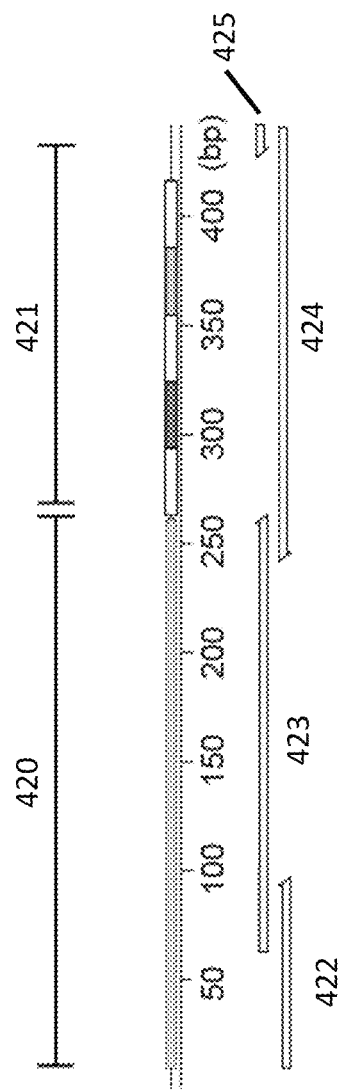
FIG. 42A and FIG. 42B illustrate an example of oligo-templated PCR amplification.
Figure 42B:
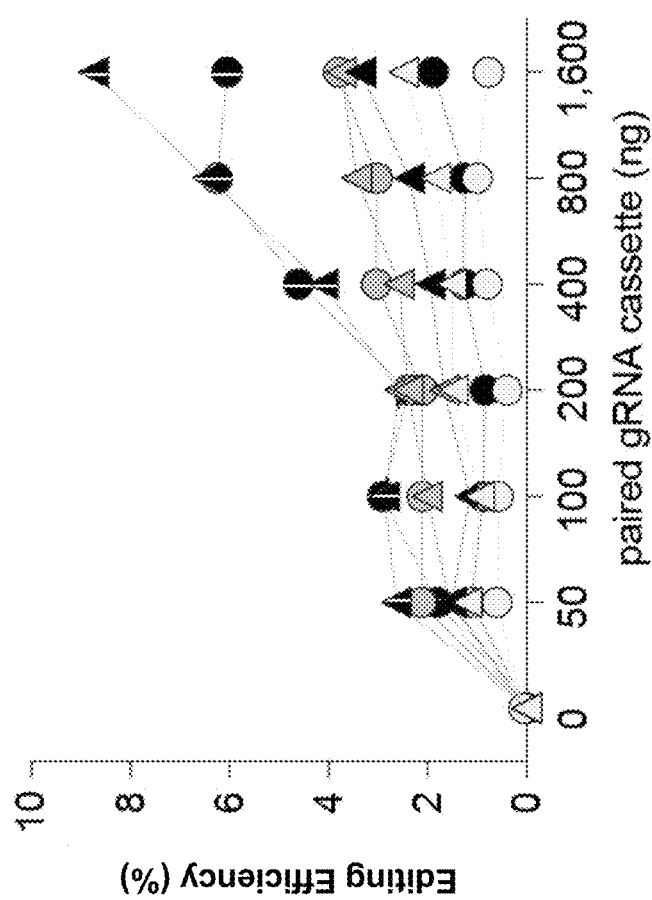

Oligo-templated PCR amplification is described herein (e.g., Example 20A). The oligo-templated PCR strategy to generate amplicons for paired gRNA expression from a human U6 (hU6) promoter (FIG. 42A, 420) in mammalian cells is illustrated in FIG. 42A and FIG. 42B. Briefly, the reverse inner oligonucleotide (FIG. 42A, 424) encodes both gRNA sequences and is modified for new target sites (also referred to as a unique primer encoding a "repeat-spacer-repeat-spacer-repeat" sequence (FIG. 42A, 421: repeat, open rectangle; spacer 1, grey rectangle; repeat, open rectangle; spacer 2, grey rectangle; repeat, open rectangle), whereas the remaining primers are invariant (FIG. 42A: forward outer primer, 422; forward inner primer, 423; reverse outer primer, 425). Editing efficiencies at target 7 (see FIG. 36B) after co-transfecting HEK293 cells with the polycistronic plasmid encoding FokI EcoCascade RNP complex and either a paired gRNA expression plasmid or paired gRNA expression amplicon are presented in FIG. 42B. In FIG. 42B, the vertical axis is editing efficiency (%) and the horizontal axis is paired gRNA cassette (ng). The data points are as follows: FokI-EcoCascade RNP complex (ng), paired gRNA plasmid, paired gRNA amplicon; 375, open triangle, open circle; 750, black triangle, black circle; 1,500, grey triangle, grey circle; 3,000, black triangle with white line, black circle with white line; respectively. The data in FIG. 42B demonstrate comparable if not higher editing efficiencies for the paired gRNA expression amplicons versus the paired gRNA expression plasmid.

For the PAM screen (FIG. 37D, FIG. 37E, FIG. 37F, FIG. 39A to FIG. 39D, FIG. 40C, and FIG. 40F), typically, cells were nucleofected with 3 µg of FokI-Cascade polycistronic plasmid and either 150 ng (FokI-PseCascade and FokI-EcoCascade) or ~80-120 ng (FokI-SthCascade) of oligo-templated paired gRNA expression amplicon (unless otherwise indicated).

Figure 38A:
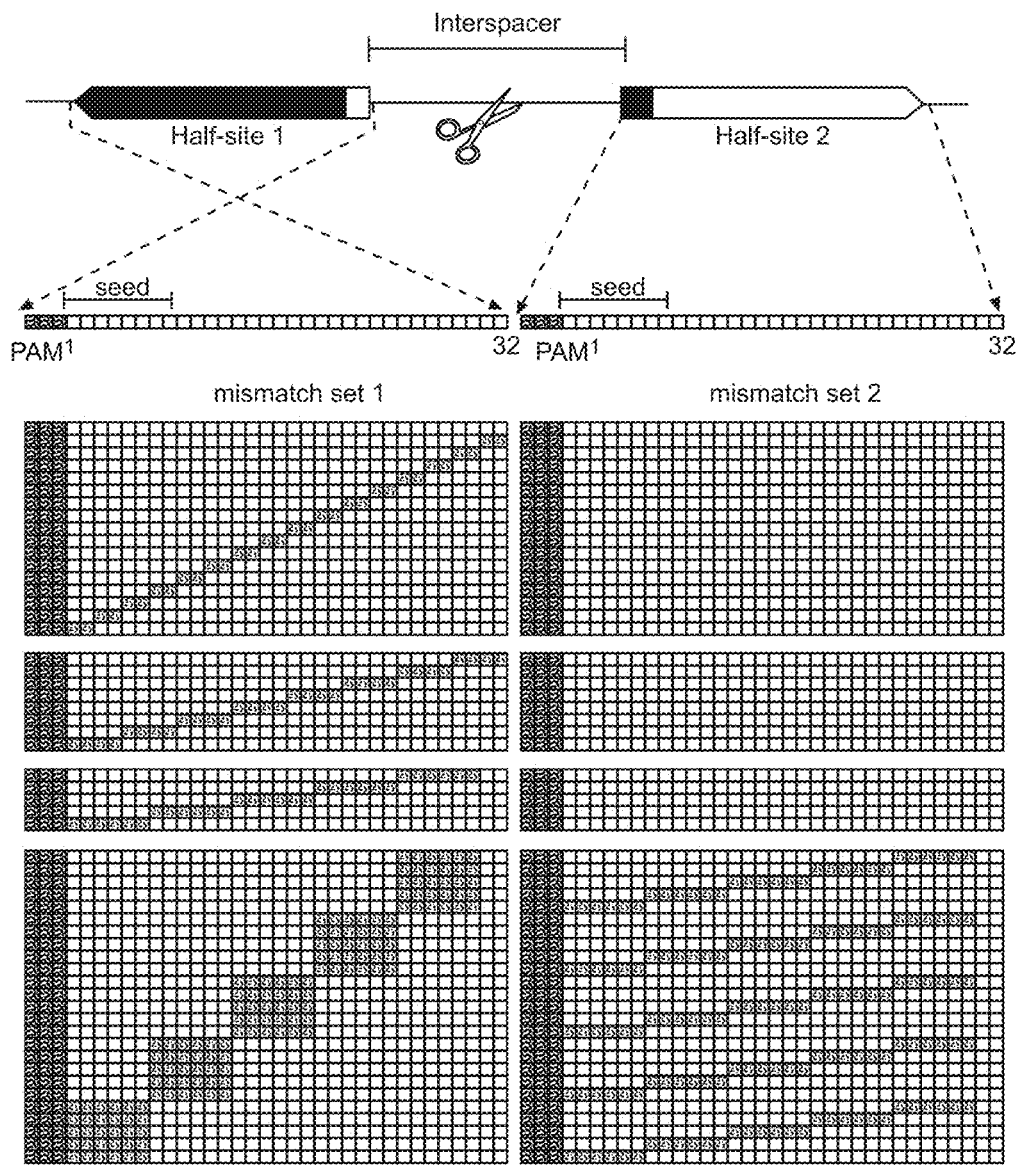

For the specificity analysis (FIG. 38A to FIG. 38C), cells were nucleofected with 3 µg of polycistronic Cascade and 150 ng of oligo-templated paired gRNA expression amplicon and harvested 5 days after nucleofection. At the top of FIG. 38A, the horizontal line represents the interspacer distance, the scissors indicate the expected cut site and the half-sites of the genomic target are with their corresponding PAM regions are shown (FIG. 38A, rectangular boxes with contrasting ends). The relationships of the illustrated half-sites to the target are shown by dashed lines. For each target 32 base pairs are illustrated and the PAM region is shown adjacent the seed sequence. FIG. 38A provides paired gRNAs designed to contain mismatches to one or both half-sites within a genomic target, as denoted by the filled boxes (excluding the PAM sites) in the grids. Note that both half-sites are displayed in the same directionality for simplicity. FIG. 38B provides relative editing efficiency at genomic target 70 for each combination of mismatched paired gRNAs plotted as a percentage of the editing efficiency for the perfectly matching gRNAs. In FIG. 38B, the top line indicates the target (FIG. 38B, Target 70), the next line represents the guide (FIG. 38B, gRNA1 and gRNA2), the next line identifies the mismatched set (FIG. 38B, mm set 1 and mm set 2), the next line illustrates the FokI-Cascade RNP complexes. The left column presents data for relative editing guide 1-mm set 1/guide 2-mm set 2, the right column for guide 1-mm set 2/guide 2-mm set 1, both columns of data present the relative editing efficiency percent (FIG. 38B Relative editing eff (%); scale 0-100), that is, the left column show data for $gRNA_1$ and $gRNA_2$ with mismatched (mm) sets 1 and 2, and the right column shows data for the same target but with swapped mismatched (mm) sets between $gRNA_1$ and $gRNA_2$ (n=1). FIG. 38C provides editing efficiency at target 73 (n=1), displayed as in FIG. 38B.

After developing the scalable method of generating paired gRNA expression cassettes by oligo-templated PCR amplification (as described herein), which eliminated the need for labor-intensive cloning steps, FokI linker and DNA interspacer lengths were rescreened across a panel of 96 genomic target sites for each homolog variant. With the 17-aa linker, FokI-PseCascade consistently yielded, on average, ~15-25% editing efficiencies within an approximately 30-33 bp interspacer window, and some targets exhibited up to ~40-50% indels (FIG. 37C). Similar trends were observed with the other homologs. PAM requirements were investigated by targeting genomic sites that harbored one cognate PAM and a second mutated PAM. PAM recognition had been shown in vitro to be far more promiscuous than the rigid 5'-GG-3' *Streptococcus pyogenes* (*S. pyogenes*) PAM requirement (see, e.g., Szczelkun, M., et al., Proc. Natl. Acad. Sci. USA 111:9798-9803 (2014); Hayes, R., et al., Nature 530:499-503 (2016); Westra, E., et al., Mol. Cell. 46:595-605 (2012); Fineran, P., et al., Proc. Natl. Acad. Sci. USA 111: E1629-E1638 (2014); Leenay, R., et al., Mol. Cell. 62:137-147 (2016)). Strikingly in vitro data demonstrated a large number of PAMs were indeed permissive for activity, with a clear rank-order preference emerging (FIG. 37D; FIG. 39A to FIG. 39D). In contrast, editing was completely abolished when the mutated PAM represented a "self" target from the CRISPR array.

Figure 39A:
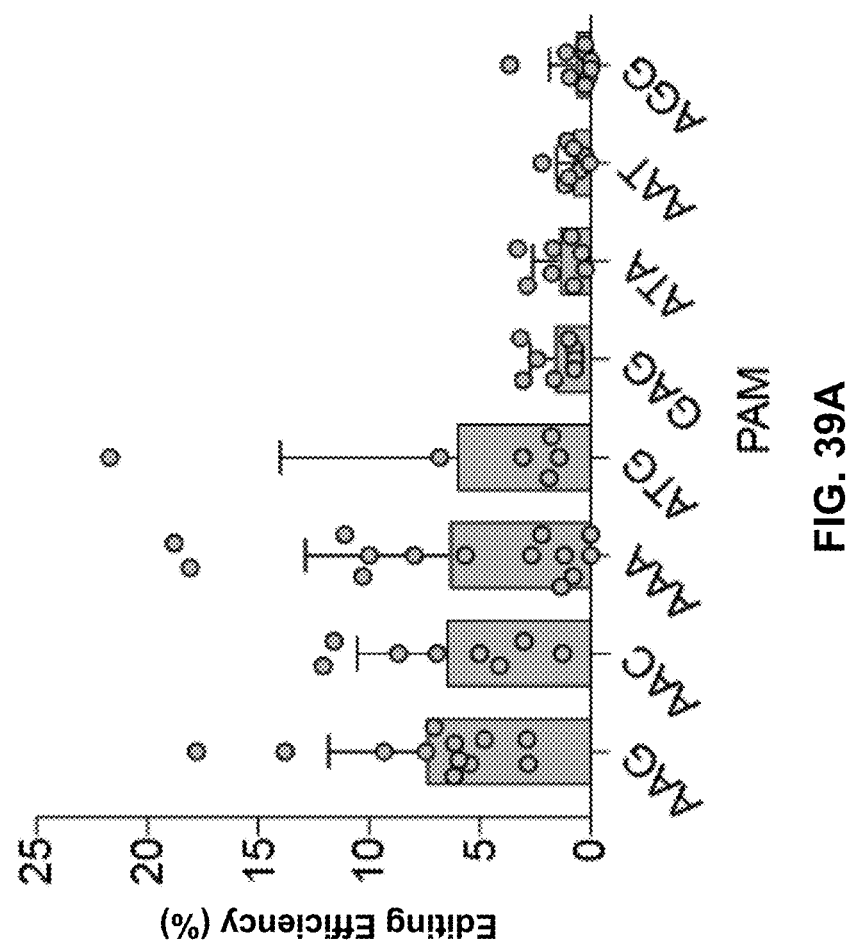
FIG. 39A, FIG. 39B, FIG. 39C, and FIG. 39D presents data related to expanded screening of PAM selectivity for three Cascade homolog variants.

In each of FIG. 39A to FIG. 39D, the vertical axis corresponds to editing efficiency (Editing Efficiency (%)) and the horizontal axis corresponds to the PAM sequence associated with the target. FIG. 39A provides FokI-PseCascade editing efficiency as a function of PAM sequence. Genomic sites contained one fixed ATG PAM and a variable PAM at the second half-site, as shown on the horizontal axis. Bars show the mean and s.d. (6-14 sites per variable PAM, n=1 per target site). Note that FIG. 37D describes data for FokI-PseCascade where one PAM is fixed at AAG and the other PAM is variable across a set of PAMs, including ATG. Thus, a subset of those PAMs are AAG-ATG. FIG. 39A describes data for FokI-PseCascade where one PAM is fixed at ATG and the other PAM is variable (FIG. 39A, horizontal axis, left to right, AAG, AAC, AAA, ATG, GAG, ATA, AAT, and AGG) across the set of PAMs, including AAG. Thus, a subset of those PAMs are also AAG-ATG and are the same AAG-ATG sites in FIG. 37D.

Figure 39B:
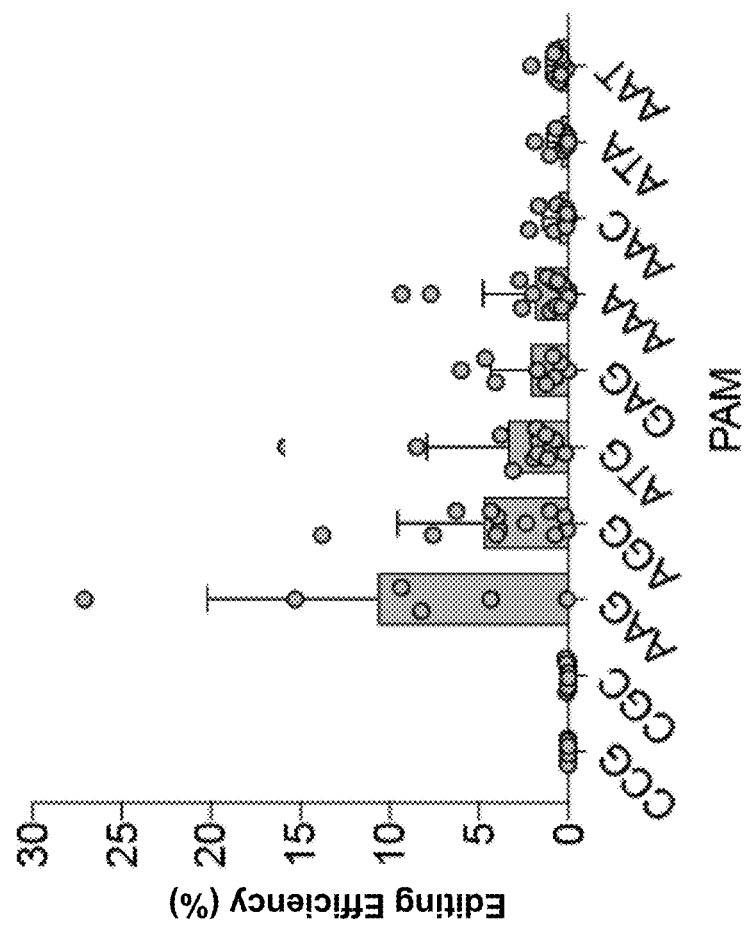
Figure 39C:
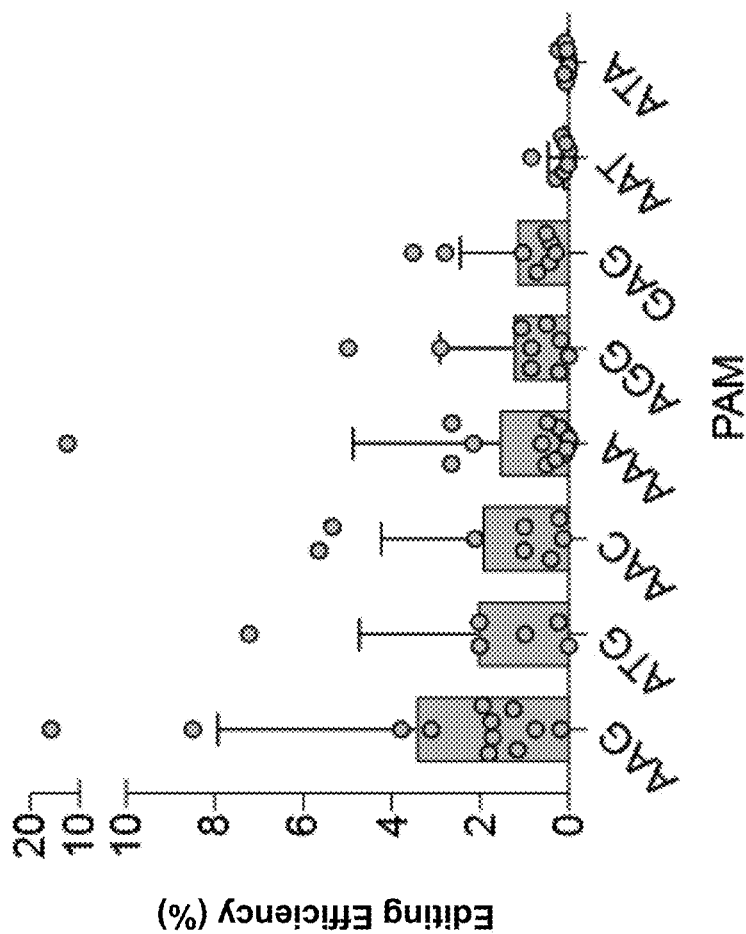
Figure 39D:
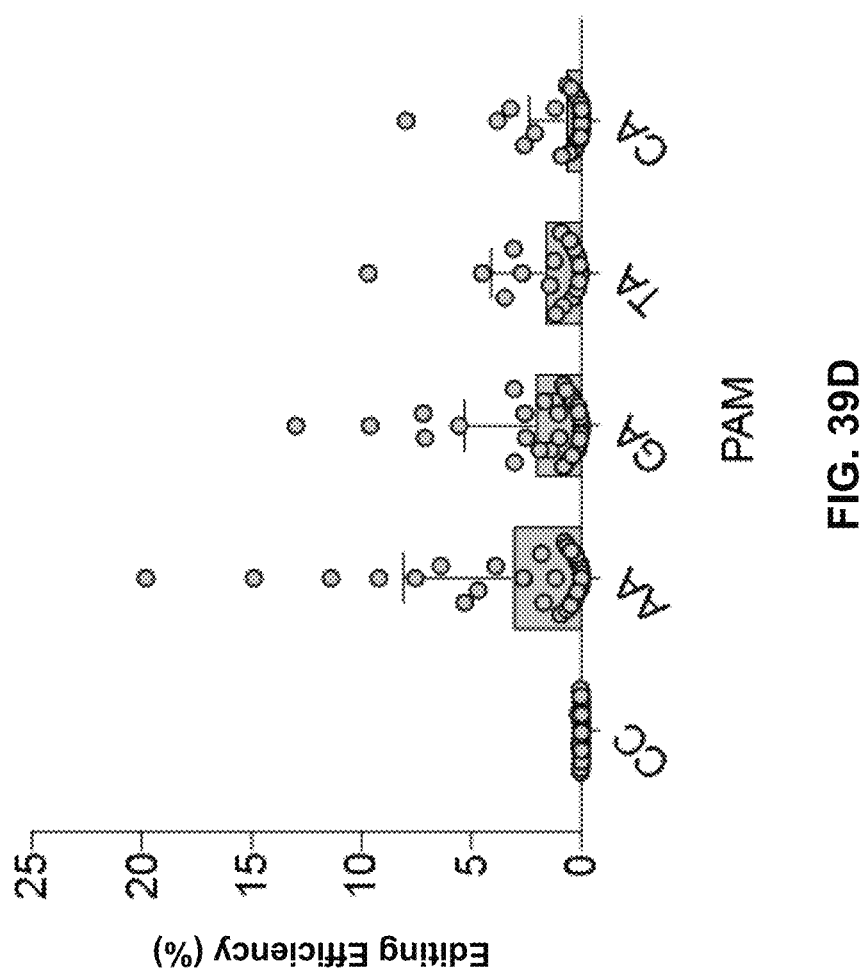

FIG. 39B provides FokI-EcoCascade editing as a function of PAM sequence (FIG. 39B, horizontal axis, left to right, CCG, CGC, AAG, AGG, ATG, GAG, AAA, AAC, ATA, and AAT). The fixed PAM was AAG and bars show the mean and s.d. (6-15 sites per variable PAM, n=1 per target site). FIG. 39C (FIG. 39C, horizontal axis, left to right, AAG, ATG, AAC, AAA, AGG, GAG, AAT, and ATA) provides a similar analysis to that shown FIG. 39B, but the first PAM was fixed to ATG (6-14 sites per variable PAM, n=1 per target site. The ATG column in FIG. 39B, corresponding to an AAG-ATG pair (mean of ~3) is identical to the AAG column in FIG. 39C, corresponding to an AAG-ATG pair (mean also of ~3). Note that the vertical-axes are of different scale. FIG. 39D provides FokI-SthCascade editing as a function of PAM sequence (FIG. 39D, horizontal axis, left to right, CC, AA, GA, TA, and CA). The fixed PAM was GAA, and bars show the mean and s.d. (18-33 sites per variable PAM; n=1 per target site).

Figure 40A:
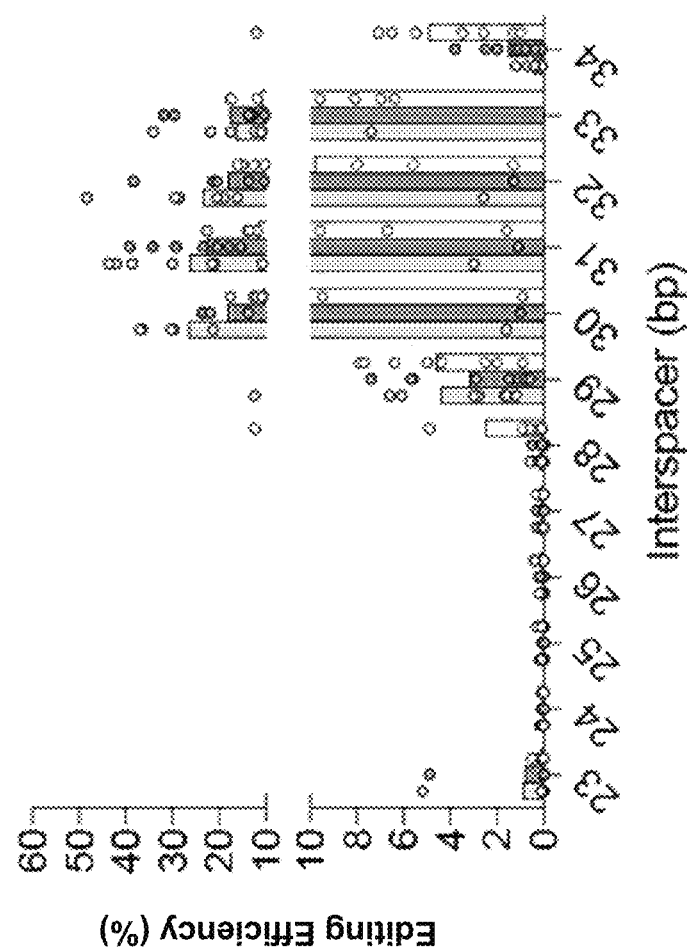
FIG. 40A, FIG. 40B, FIG. 40C, FIG. 40D, FIG. 40E, and FIG. 40F present data related to exemplary changes in editing efficiency of engineered Type I CRISPR-Cas complexes.
Figure 40B:
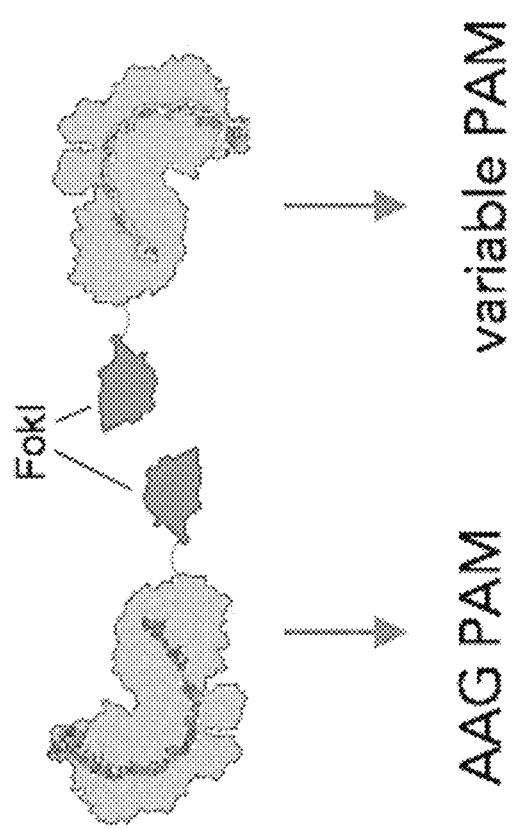
Figure 40C:
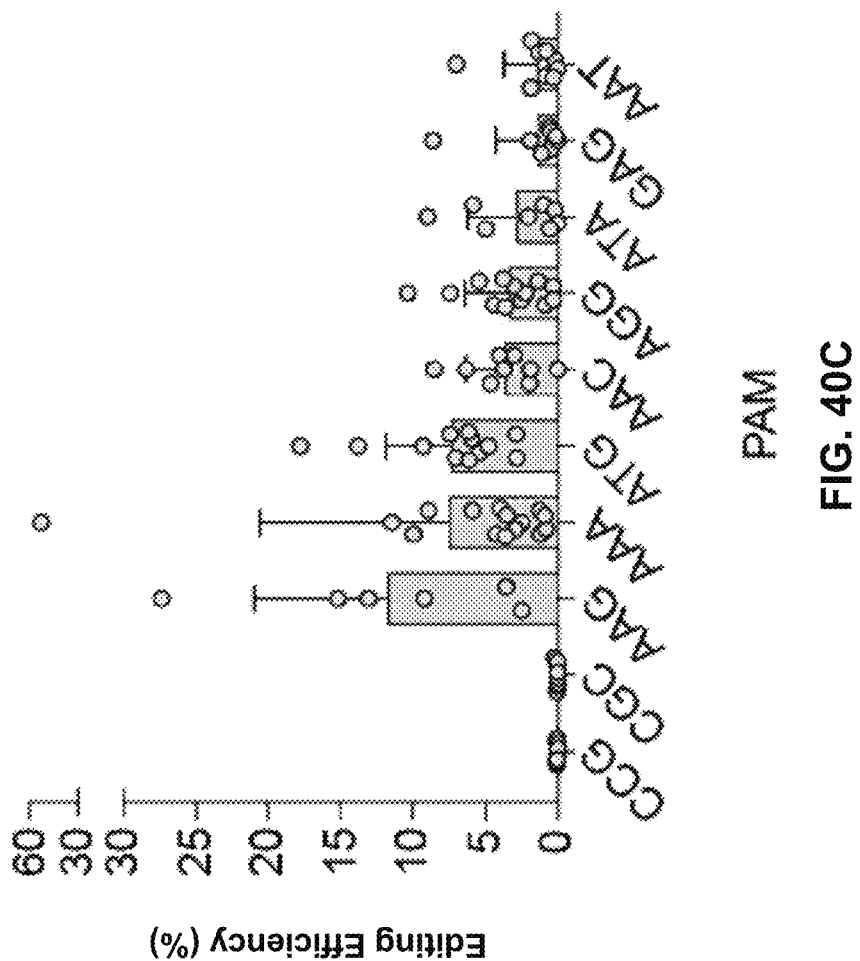
Figure 40D:
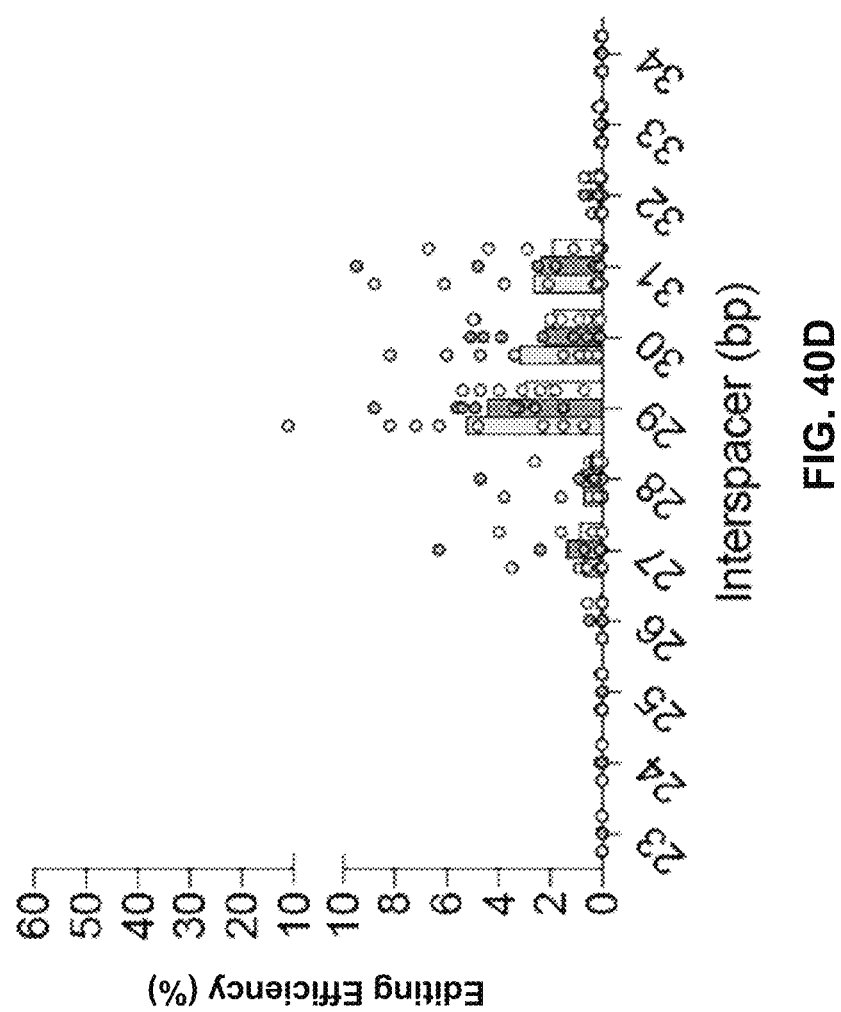
Figure 40E:
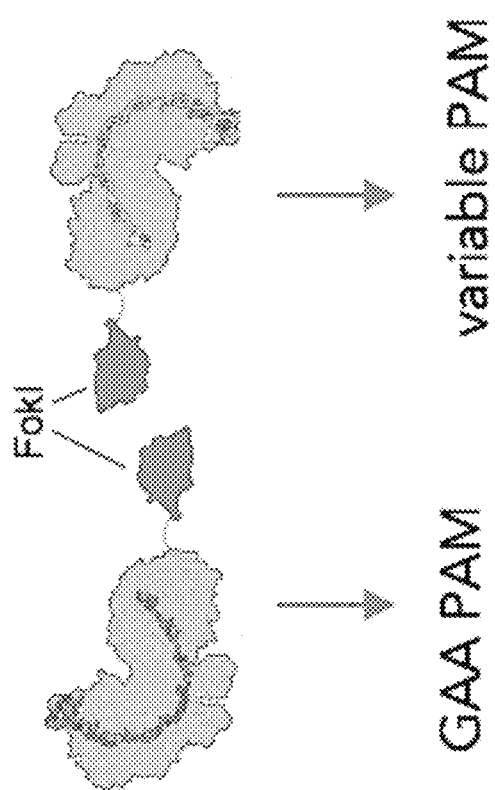
Figure 40F:
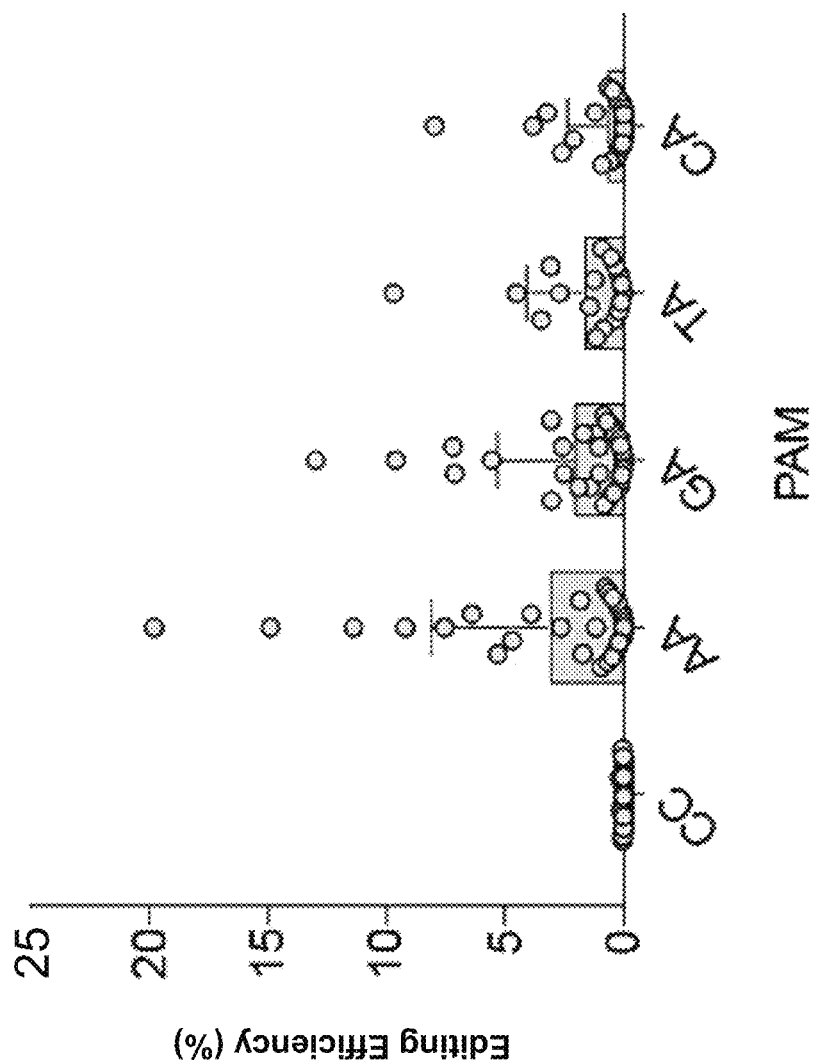

FIG. 40A, FIG. 40B, FIG. 40C, FIG. 40D, FIG. 40E, and FIG. 40F present data related to exemplary changes in editing efficiency of engineered Type I CRISPR-Cas complexes. The data presented in FIG. 40A (FokI-PseCascade) and FIG. 40D (FokI-SthCascade) for percentage editing efficiency (vertical axis) versus interspacer distance in bps (horizontal axis) was obtained essentially as described in Example 20C for the data presented in FIG. 41A and FIG. 41C. In FIG. 40A and FIG. 40D, the horizontal axis represents 23-34 bp interspacer distances, and the bars of the graph, left to right, are FokI-Cas8 polypeptide linker lengths of 17 aa (light grey bars), 20 amino acids (dark grey bars) and 30 aa (white bars). The data presented in FIG. 40C and FIG. 40F was obtained essentially as described for FIG. 39B. FIG. 40C and FIG. 40F provide FokI-PseCascade and FokI-SthCascade editing (FIG. 40C, FIG. 40F, vertical axis, Editing Efficiency (%)) as a function of PAM sequences (FIG. 40C, left to right, CCG, CGC, AAG, AAA, ATG, AAC, AGG, ATA, GAG, and AAT; FIG. 40F, left to right, CC, AA, GA, TA, and CA). FIG. 40B illustrates the FokI-PseCascade RNP complexes. The fixed PAM for FokI-PseCascade was AAG (FIG. 40B, AAG PAM) and the other PAM is variable across a set of PAMs (FIG. 40B, variable PAM). FIG. 40E illustrates the FokI-SthCascade RNP complexes. The fixed PAM for FokI-SthCascade was GAA (FIG. 40B, GAA PAM) and the other PAM is variable across a set of PAMs (FIG. 40E, variable PAM). FokI-PseCascade was rescreened for linker and interspacer preference, and the data demonstrated nearly 50% editing. PAM preference was also examined. From this data, an in vitro rank order preference of PAMs was determined. Essentially the same analysis was performed for a variant from *Streptococcus thermophilus*. Editing was lower in the *S. thermophilus* system. However, the data presented herein demonstrates that in vivo, in human cells, the PAM preference for the *S. thermophilus* system is very promiscuous. The fact that a single A upstream of the protospacer (i.e., target sequence) was permissive for editing, generally provides an increased number of potential target sequences within a gene (e.g., relative to the number of potential Class 2 Type II CRISPR-Cas9 PAM-associated target sites within the same gene). Furthermore, the in vivo data presented herein correlates with the in vitro PAM preferences demonstrated by Sinkunas, T., et al., EMBO J. 32:385-394 (2013).

The accumulation of NGS data across hundreds of edited genomic sites provided the ability to characterize DNA repair outcomes of DSBs introduced by FokI-PseCascade. Focusing on 40 unique sites with indel frequencies >10%, the frequencies of deletions and insertions were analyzed as a function of total mutant reads within a 50 bp window surrounding a predicted cleavage site. Insertions of 2-4 bp were highly enriched and present in the vast majority of sites examined (FIG. 37E). Detailed inspection showed that ~90% of these insertions contained perfect duplications of sequences adjacent to the cleavage site. Although not wishing to be limited by any particular theory, such duplications may be the consequence of templated repair of staggered cuts introduced by dimeric FokI.

The specificity of FokI-PseCascade was evaluated by editing two high-efficiency target sites with an extensive panel of mismatched paired gRNAs (FIG. 38A). Previous studies of Cascade have highlighted an ~8-nt PAM-proximal seed sequence, as well as mismatch promiscuity at every 6th position within the 32-nt guide gRNA, due to these bases being flipped out of the RNA-DNA heteroduplex structure formed upon target binding (see, e.g., Jung, C., et al., Cell 170:35-47 (2017); Mulepati, S., et al., Science 345:1479-1484 (2014); Fineran, P., et al., Proc. Natl. Acad. Sci. USA 111: E1629-E1638 (2014); Semenova, E., et al., Proc. Natl. Acad. Sci. USA 108:10098-10103 (2011)). Mismatches within the PAM-proximal seed region were highly deleterious for genome editing, whereas mismatches distal from the PAM were well tolerated, leading to near-wild-type editing efficiencies (FIG. 38B; FIG. 38C). When blocks of mismatches were present in both half-sites, however, editing dropped dramatically across the entire panel of paired gRNAs tested (FIG. 38B, FIG. 38C). Based on the data on the PAM and interspacer data of FokI-PseCascade-mediated genome editing (FIG. 38C; FIG. 37D), one advantage of the engineered Type I CRISPR-Cas complexes of the present invention is that a targetable site can occur every ~20 to ~30 bp in the human genome, whereas editing at potential off-target sites is unlikely.

Accordingly, in one embodiment of the present invention, the potential targetable sites, or "target density," of a given engineered FokI-Cascade system is a function of its efficient interspace distance and PAM preference, and will have some variability across homologs. In some embodiments, the following criteria can be used to calculate the target density in the human genome for FokI-PseCascade, FokI-EcoCascade, and FokI-SthCascade (the data were extrapolated to calculate predicted target density).

FokI-PseCascade, target density can be calculated using the following motif:

5'-[half-site$_1$-PAM$_1$]-[interspacer]-[PAM$_2$-half-site$_2$]-3'.

Here, [half-site$_1$-PAM$_1$] denotes the reverse-complement of the half-sites gRNA$_1$ target-strand target sequence and PAM, and [half-site$_2$-PAM$_2$] denotes the half-site$_2$ gRNA$_2$ non-target strand PAM and target-sequence. Based on the distribution of interspacer lengths that supported editing with FokI-PseCascade (see, e.g., FIG. 37D), an efficient interspacer length is about 30-33 bp. PAMs were defined as belonging to either set 1 which gave the highest editing (AAG, AAA, ATG, AAC) or to set 2 if they contained any of the tested PAMs that showed activity (AAG, AGG, ATG, GAG, AAA, AAC, AAT, ATA) (see, e.g., FIG. 39A; FIG. 40B).

From this, potential target sites satisfying the preferred interspacer length criterion with two PAMs belonging to either set 1 or set 2 will occur on average every 33.4 bp or 9.2 bp, respectively.

The target density for FokI-EcoCascade was determined similarly, except the interspacer length was defined as 31-33 and PAMs were defined as belonging to either set 1, which gave the highest editing (AAG, AGG, ATG, GAG, AAA), or set 2 if they contained any of the tested PAMs that showed activity (AAG, AGG, ATG, GAG, AAA, AAC, AAT, ATA) (see, e.g., FIG. 39C; FIG. 39D). From this, potential target sites were calculated with set 1 PAMs or set 2 PAMs occurring, on average, every 30.4 bp or 12.2 bp, respectively.

The human genome target density for FokI-SthCascade was determined similarly, except the interspacer length was defined as 29-31 bp and PAMs were defined as NNA (see, e.g., FIG. 39D). From this, potential target sites were calculated to occur, on average, every 4 bp.

Accordingly, engineered Type I CRISPR-Cas complexes, as described herein, provide a method to provide a variety of potential target sites by providing a number of PAM-adjacent target sequences available for genomic editing. Thus, one embodiment of the present invention relates to a method of using PAM sequences associated with engineered Type I CRISPR-Cas complexes to provide an increased number of available target sequences within a gene (e.g., relative to the number of available target sequences associated with PAM sequences of Class 2 CRISPR-Cas Type II or Type V systems). Applications of this method relate to use of engineered Type I CRISPR-Cas complexes that can include, but are not limited to, binding to and/or cleavage of a target sequence, mutation of a target sequence, transcriptional regulation related to a target sequence or regulatory elements thereof, as well as intentional modification, change, and/or markedly different structural change (e.g., in a product of the gene) mediated by use of the engineered Type I CRISPR-Cas complexes described herein.

In some embodiments, the engineered Type I CRISPR-Cas effector complexes described herein can be used to generate non-human transgenic organisms by site specifically introducing a selected polynucleotide sequence (e.g., a portion of a donor polynucleotide) at a DNA target locus in the genome to generate a modification, change, and or mutation of the gDNA. The transgenic organism can be an animal or a plant.

A transgenic animal is typically generated by introducing engineered Type I CRISPR-Cas effector complexes into a zygote cell. A basic technique, described with reference to making transgenic mice (see, e.g., Cho, A., et al., "Generation of Transgenic Mice," Current Protocols in Cell Biology, CHAPTER.Unit-19.11 (2009)) involves five basic steps: first, preparation of a system, as described herein, including a suitable donor polynucleotide; second, harvesting of donor zygotes; third, microinjection of the system into the mouse zygote; fourth, implantation of microinjected zygotes into pseudo-pregnant recipient mice; and fifth, performing genotyping and analysis of the modification of the gDNA established in founder mice. The founder mice will pass the genetic modification to any progeny. The founder mice are typically heterozygous for the transgene. Mating between these mice will produce mice that are homozygous for the transgene 25% of the time.

Methods for generating transgenic plants are also well known and can be applied using engineered 1 Type I CRISPR-Cas effector complexes. A generated transgenic plant, for example using *Agrobacterium*-mediated transformation, typically contains one transgene inserted into one chromosome. It is possible to produce a transgenic plant that is homozygous with respect to a transgene by sexually mating (i.e., selfing) an independent segregant transgenic plant containing a single transgene to itself. Typical zygosity assays include, but are not limited to, single nucleotide polymorphism assays and thermal amplification assays that distinguish between homozygotes and heterozygotes.

In a sixth aspect, the present invention relates to use of engineered Type I CRISPR-Cas effector complexes to create substrate channels. In some embodiments, fusion proteins comprising substrate channel elements and Cas7 subunit proteins are constructed. These Cas7 fusion proteins are then assembled into an engineered Type I CRISPR-Cas effector complex (e.g., comprising Cse2, Cas5, Cas6, Cas7-substrate channel element fusions, and Cas8). In some embodiments, the crRNA of the engineered Type I CRISPR-Cas effector complex can be extended to accommodate additional Cas7 subunits (see, e.g., Luo, M., et al., Nucleic Acids Res. 44:7385-7394 (2016)). Different substrate elements can be fused to Cas7 and then mixed at the desired stoichiometry. When these various Cas7 subunits assemble into a complete Type I CRISPR-Cas effector complex, co-localization of substrate elements can enhance the efficacy of substrate channeling.

In some embodiments, an RNA scaffold is constructed such that multiple Cas7-substrate channel element fusions can bind to it in the absence of other Type I CRISPR-Cas effector complex components.

Substrate channel elements can be fused to the N-terminus of Cas7 and/or the C-terminus of Cas7. In addition, circular permutations of Cas7 can be fused to substrate channel elements.

Figure 11A:
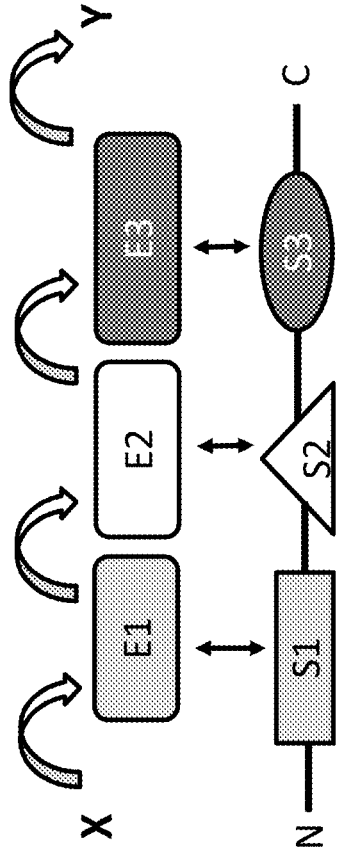
FIG. 11A and FIG. 11B illustrate examples of substrate channels.
Figure 11B:
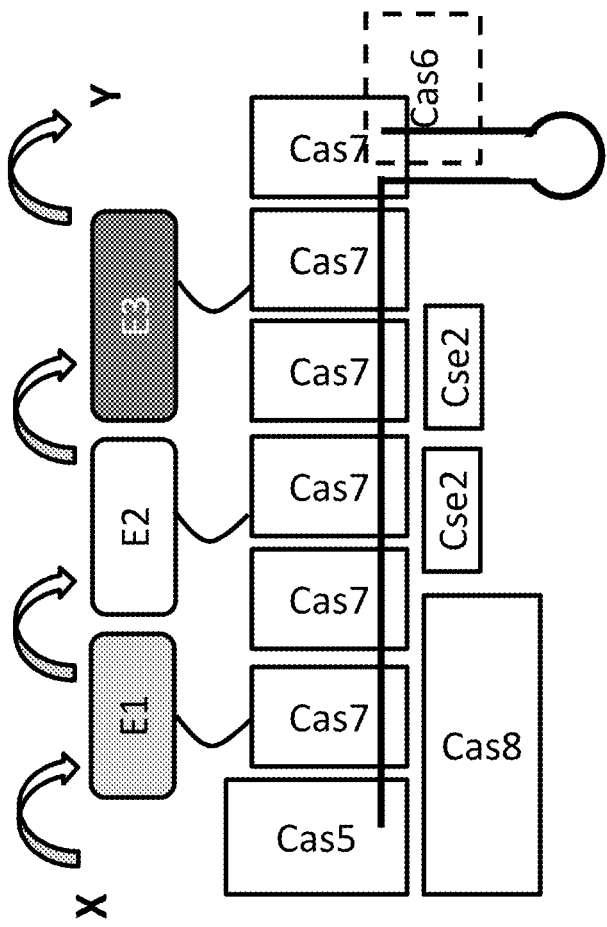

FIG. 11A and FIG. 11B presents illustrations of substrate channels consisting of three consecutive enzymes in a pathway. Substrate channels facilitate the passing of intermediary metabolic products directly to the active site of the consecutive enzyme in the metabolic pathway chain without release into the extra channel space. FIG. 11A illustrates a typical arrangement of an engineered substrate channel. Enzymes E1, E2, and E3 interact covalently or non-covalently to a scaffold protein (S1, S2, S3) matrix. The double-headed arrows represent interactions (e.g., affinity interactions) between an enzyme and a scaffold protein. The substrate (X) is then processed to the product (Y) without release to the extra channel space. FIG. 11B illustrates one embodiment of the present invention comprising an engineered Type I CRISPR-Cas effector complex that carries enzymes E1, E2, and E3 as fusion proteins to Cas7 subunit proteins (i.e., a covalent interaction), thus creating a substrate channel. cpCas7 proteins and backbones formed of cpCas7 proteins can also be useful in the practice of this aspect of the present invention.

In other embodiments, substrate channel elements can be fused to Cas6. The Cas6 subunit of Cascade complexes recognizes specific RNA hairpin structures. An RNA scaffold can be constructed that is composed of multiple Cas6 RNA hairpin structures concatenated together. Cas6 peptides from different Cascade complexes have different recognition sequences. Accordingly, RNA scaffolds can be constructed from multiple orthogonal Cas6 RNA hairpins. By fusing different substrate channel elements to orthogonal Cas6 peptides, substrate channel complexes can be assembled in specific stoichiometry.

Substrate channel elements can be fused to the N-terminus of Cas6 and/or the C-terminus of Cas6. In addition, circular permutations of Cas6 can be fused to substrate channel elements.

In some embodiments, a heterologous metabolic pathway of interest can be expressed in a model organism, such as *E. coli*. When genes are heterologously expressed, the genes can be codon-optimized to express the genes more efficiently.

In one embodiment, the metabolic pathway of interest is the mevalonate pathway from *Saccharomyces cerevisiae*. Substrate channel elements of this pathway include, but are not limited to, acetoacetyl-CoA-thioase (AtoB), hydroxymethylglutaryl-CoA synthase (HMGS), and hydroxy-methylglutaryl-CoA reductase (HMGR).

In another embodiment, the metabolic pathway of interest is the glycerol synthesis pathway from *S. cerevisiae*. Substrate channel elements of this pathway include, but are not limited to, glycerol-3-phosphate dehydrogenase (GPD1) and glycerol-3-phosphate phosphatase (GPP2).

In yet another embodiment, the metabolic pathway of interest is the starch hydrolysis pathway from *Clostridium stercorarium*. Substrate channel elements of this pathway include, but are not limited to, CelY and CelZ.

In an additional embodiment, the metabolic pathway of interest is the glucose phosphotransferase pathway from *E. coli*. Substrate channel elements of this pathway include, but are not limited to, trehalose-6-phosphate synthetase (TPS) and trehalose-6-phosphate phosphatase (TPP).

In a seventh aspect, the present invention relates to site-directed recruitment of functional domains fused to Cascade subunit proteins by complexes comprising a Class 2 Type II Cas9 protein and a nucleic acid-targeting nucleic acid (NATNA). Functional domains are disclosed herein and include, but are not limited to, protein domains having enzymatic function, capable of transcriptional activation, or capable of transcriptional repression. Example 13A and Example 13B describe a method of engineering a Class 2 Type II CRISPR sgRNA, crRNA, tracrRNA, or crRNA and tracrRNA sequences with a Class 1 Type I CRISPR repeat stem sequence, allowing for the recruitment of one or more Cascade subunit proteins to a Type II CRISPR Cas protein/guide RNA complex binding site.

Figures 12A, 12B:
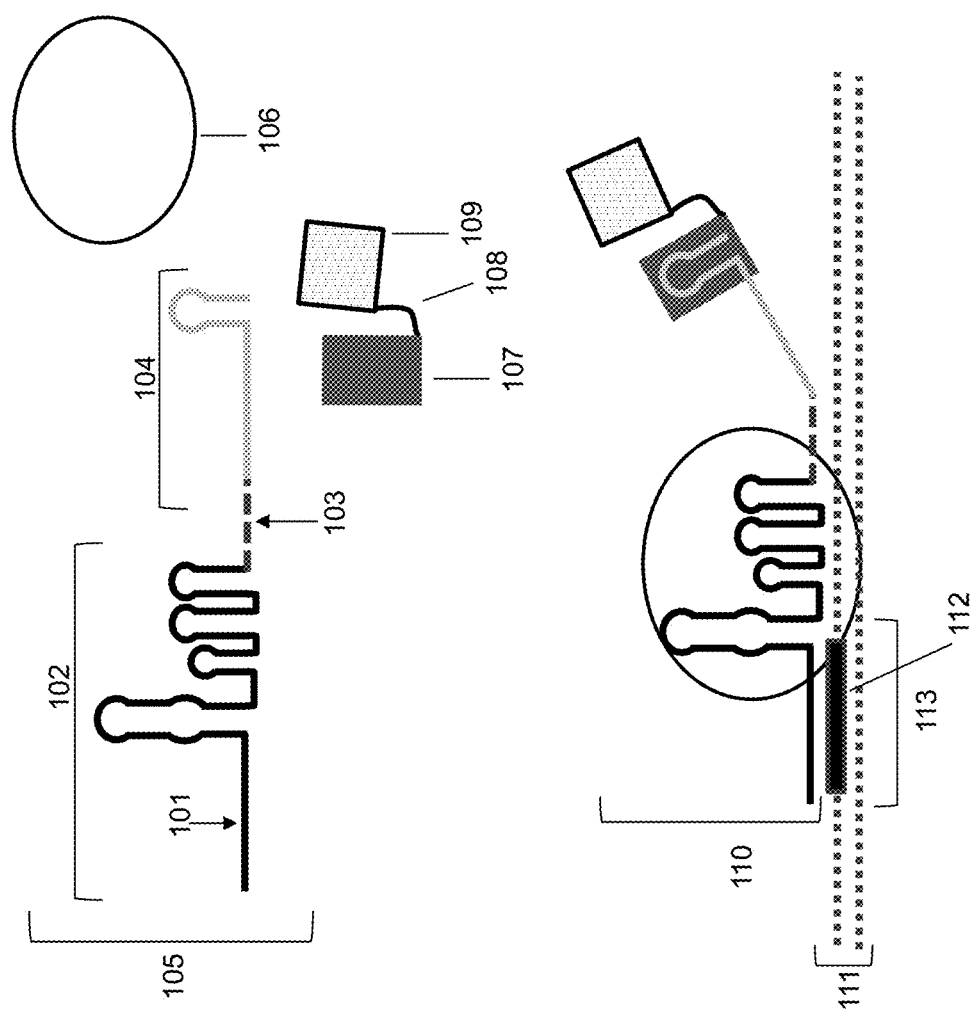

FIG. 12A, FIG. 12B, and FIG. 12C present a generalized illustration of the site-directed recruitment of a functional protein domain fused to a Cascade subunit protein by a dCas9: NATNA complex to a target site. A Class 2 Type II CRISPR NATNA (FIG. 12A, 102) comprising a spacer sequence (FIG. 12A, 101) is covalently linked through a linker nucleic acid sequence (FIG. 12A, 103) to a Class 1 Type I CRISPR repeat stem sequence (FIG. 12A, 104). The Type II CRISRP NATNA covalently linked to the Type I CRISPR repeat stem sequence (FIG. 12A, 105) is capable of binding to a Type II dCas9 (FIG. 12A, 106) and a Type I Cascade subunit protein (e.g., Cas6; FIG. 12A, 107), which is fused though a linker sequence (FIG. 12A, 108) to a functional protein domain (e.g., an enzymatic domain, a transcriptional activation or repression domain; FIG. 12A, 109) to form an RNP complex. This RNP complex (FIG. 12B, 110) is capable of targeting a double-stranded DNA (FIG. 12B, 111) comprising a target sequence (FIG. 12B, 112) complementary to the Type II CRISPR NATNA spacer sequence (FIG. 12A, 101). Target recognition by the RNP complex results in hybridization (FIG. 12B, 113) between the spacer sequence (FIG. 12A, 101) and the target sequence (FIG. 12B, 112). Localization of the Cascade subunit-functional domain fusion protein to the DNA allows for modification of the DNA by the functional protein domain or transcriptional regulation of an adjacent gene (FIG. 12C, 114).

In an eighth aspect, the present invention relates to compositions comprising engineered Type I CRISPR-Cas effector complexes, engineered guide polynucleotides, and combinations thereof. In some embodiments, the engineered Type I CRISPR-Cas effector complex comprises an associated Cas3 fusion protein. Wild-type Type I CRISPR-Cas systems require coordinated action of the Cascade effector complex for DNA targeting and the Cas3 helicase-nuclease for processive DNA degradation. In one embodiment of the present invention, Type I CRISPR-Cas effector complexes were engineered to make precise DSBs by fusing the complex to a nuclease domain (e.g., a non-specific FokI endonuclease domain). This approach uses paired guide polynucleotides that target two half-site DNA sequences separated by an intervening sequence (i.e., the interspacer).

An embodiment of this aspect of the present invention relates to a composition comprising two engineered Type I CRISPR-Cas effector complexes each comprising a spacer and a fusion protein comprising a Cas subunit and an endonuclease (e.g., a FokI; see, e.g., the Cascade complexes of FIG. 2A, FIG. 2B, and FIG. 2C), wherein at least two parameters are varied to modulate genome editing efficiency. Such parameters include:

the length of a linker polypeptide used to produce the fusion protein comprising a Cas subunit protein and the endonuclease (e.g., FokI); and the length of the interspacer distance between the nucleic acid target sequences to which the spacers are capable of binding.

Guidance is provided herein regarding the amino acid composition and sequence linker polypeptides.

One embodiment of this aspect of the present invention is a composition comprising:

a first engineered Type I CRISPR-Cas effector complex comprising, a first Cse2 subunit protein, a first Cas5 subunit protein, a first Cas6 subunit protein, and a first Cas7 subunit protein, a first fusion protein comprising a first Cas8 subunit protein and a first FokI, wherein the N-terminus of the first Cas8 subunit protein or the C-terminus of the first Cas8 subunit protein is covalently connected by a first linker polypeptide to the C-terminus or N-terminus, respectively, of the first FoId, and wherein the first linker polypeptide has a length of between about 10 amino acids and about 40 amino acids, and a first guide polynucleotide comprising a first spacer capable of binding a first nucleic acid target sequence; and a second engineered Type I CRISPR-Cas effector complex comprising, a second Cse2 subunit protein, a second Cas5 subunit protein, a second Cas6 subunit protein, and a second Cas7 subunit protein, a second fusion protein comprising a second Cas8 subunit protein and a second FokI, wherein the N-terminus of the second Cas8 subunit protein or the C-terminus of the second Cas8 protein is covalently connected by a second linker polypeptide to the C-terminus or N-terminus, respectively, of the second FokI, and wherein the second linker polypeptide has a length of between about 10 amino acids and about 40 amino acids, and a second guide polynucleotide comprising a second spacer capable of binding a second nucleic acid target sequence, wherein a protospacer adjacent motif (PAM) of the second nucleic acid target sequence and a PAM of the first nucleic acid target sequence have an interspacer distance between about 20 base pairs and about 42 base pairs.

Examples of such a first engineered Type I CRISPR-Cas effector complex bound to a first nucleic acid target sequence and a second engineered Type I CRISPR-Cas effector complex bound to a second nucleic acid target sequence are illustrated in FIG. 2A, FIG. 2B, and FIG. 2C.

In some embodiments, the length of the first linker polypeptide and/or the second linker polypeptide is a length of between about 15 amino acids and about 30 amino acids, or between about 17 amino acids and about 20 amino acids. In one embodiment, the length of the first linker polypeptide and the second linker polypeptide are the same.

The first Cas8 subunit protein and the second Cas8 subunit protein can each comprise identical amino acid sequences of the Cas8 subunit protein.

Similarly, the first Cse2 subunit protein and the second Cse2 subunit protein can each comprise identical amino acid sequences of the Cse2 subunit protein, the first Cas5 subunit protein and the second Cas5 subunit protein can each comprise identical amino acid sequences of the Cas5 subunit protein, the first Cas6 subunit protein and the second Cas6 subunit protein can each comprise identical amino acid sequences of the Cas6 subunit protein, the first Cas7 subunit protein and the second Cas7 subunit protein can each comprise identical amino acid sequences of the Cas7 subunit protein, and combinations thereof.

Typically, the N-terminus of the first Cas8 subunit protein is covalently connected by the first linker polypeptide to the C-terminus of the first FokI, the C-terminus of the first Cas8 subunit protein is covalently connected by a first linker polypeptide to the N-terminus of the first FokI, the N-terminus of the second Cas8 subunit protein is covalently connected by the second linker polypeptide to the C-terminus of the second FokI, the C-terminus of the second Cas8 subunit protein is covalently connected by a second linker polypeptide to the N-terminus of the second FokI, and combinations thereof.

Embodiments of this aspect of the present invention include embodiments wherein the length between the second nucleic acid target sequence and the first nucleic acid target sequence is an interspacer distance between about 22 base pairs and about 40 base pairs, between about 26 base pairs and about 36 base pairs, between about 29 base pairs and about 35 base pairs, or between about 30 base pairs and about 34 base pairs.

The first FokI and the second FokI can be monomeric subunits that are capable of associating to form a homodimer, or distinct subunits that are capable of associating to form a heterodimer.

In a preferred embodiment, the guide polynucleotides comprise RNA.

In some embodiments, gDNA comprises the PAM of the second nucleic acid target sequence and the PAM of the first nucleic acid target sequence.

In some embodiments, the engineered Type I CRISPR-Cas effector complexes are based on Type I CRISPR-Cas effector complexes of one or more organisms selected from the group consisting of *Salmonella enterica*, *Geothermobacter* sp. (strain EPR-M), *Methanocella arvoryzae* MRE50, *Streptococcus thermophilus* (e.g., *Streptococcus thermophilus* (strain ND07), *Pseudomonas* sp. S-6-2, and *E. coli*. In preferred embodiments, the engineered Type I CRISPR-Cas effector complexes are based on Type I CRISPR-Cas effector complexes of *Streptococcus thermophilus* (e.g., *Streptococcus thermophilus* (strain ND07), *Pseudomonas* sp. S-6-2, and/or *E. coli*. *Pseudomonas* sp. S-6-2 induced ~10-fold higher editing efficiencies than the *E. coli* homolog, and roughly one half of the other homologs tested showed activities on par with *E. coli*, demonstrating that engineered Type I CRISPR-Cas effector complexes from diverse Type I systems can be functionally used for genome editing in human cells.

The data presented in Example 18A, Example 18B, Example 18C, Example 18D, Example 20A, Example 20B, and Example 20C demonstrate that varying the length of the linker polypeptide used to produce the fusion protein comprising the Cas subunit protein and the FokI and/or varying the length of the interspacer distance between the nucleic acid target sequences to which the spacers are capable of binding facilitate modulation of genome editing efficiency in cells.

Figures 13A, 13B:
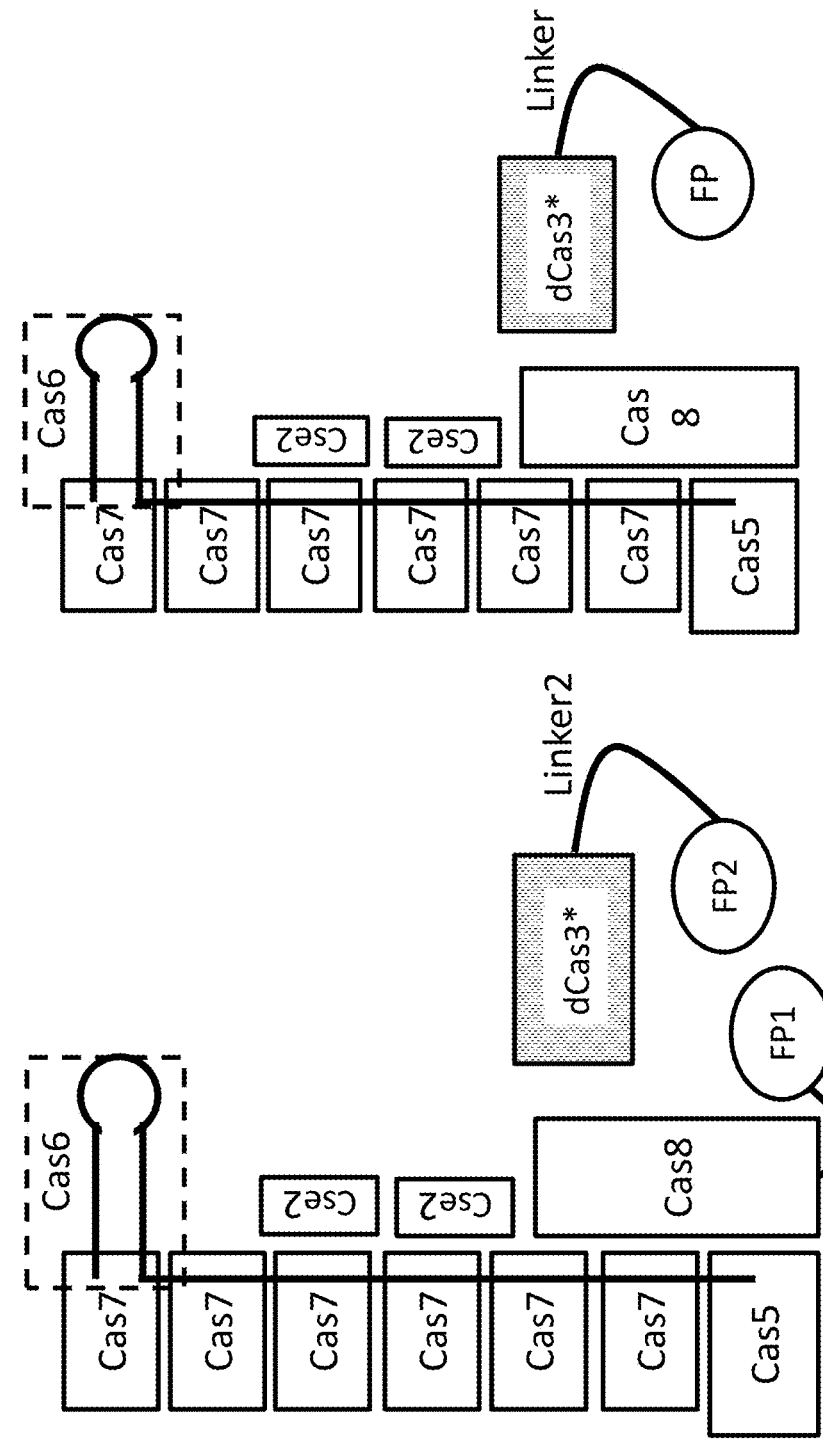

In yet another embodiment, the present invention relates to an engineered Type I CRISPR-Cas effector complex comprising a first fusion protein that comprises a Cascade subunit protein (e.g., a Cas8 subunit protein) and a first functional domain (e.g., FokI), and a second fusion protein that comprises a dCas3* protein and a second functional domain (e.g., FokI) (FIG. 13A: Cas7, Cas5, Cas8, Cse2, and Cas6, the dashed box around Cas6 indicates its interaction with the crRNA hairpin; the cRNA is illustrated as a black line comprising the hairpin). The engineered Type I CRISPR-Cas effector complex comprising the first functional domain (e.g., FokI) (FIG. 13A, Cas8-linker1-FP1 fusion) can bind DNA and can then recruit the dCas3*-second functional domain (e.g., FokI) fusion protein (FIG. 13A, dCas3*-linker2-FP2). In the case where the first functional domain (FIG. 13A, Cas8-linker1-FP1 fusion) and the second functional domain (FIG. 13A, dCas3*-linker2-FP2) comprise subunits of a dimeric protein, the dCas3*-second functional domain (e.g., FokI) fusion protein binds the engineered Type I CRISPR-Cas effector complex comprising the first functional domain (e.g., FokI) facilitating dimerization of the first functional domain and the second functional domain (FIG. 13A). FIG. 14A illustrates the binding to dsDNA of an engineered Type I CRISPR-Cas effector complex (FIG. 14A, Cascade) comprising the first functional domain (FIG. 14A, FD1) connected to a Cas subunit protein (FIG. 14A, striped box) via a linker polypeptide (FIG. 14A, Linker 1) and a dCas3* connected to a second functional domain (FIG. 14A, FD2) via a linker polypeptide (FIG. 14A, Linker 2) associated with the Cascade complex; thus bringing FD1 and FD2 into proximity and facilitating the interaction of FD1 and FD2. Binding of the Cascade complex involves a single PAM sequence (FIG. 14A, PAM, open box). In FIG. 14A, dsDNA is illustrated as paired, horizontal dashed lines. In the case of the functional domain being a dimeric endonuclease (e.g., FokI), the proximity of FD1 and FD2 facilitates formation of a functional dimer.

One advantage of this embodiment of the present invention is that a single Cascade complex (recognizing a single PAM sequence) can be used to cleave a double-stranded nucleic acid target sequence, versus using two FokI-Cascade complexes (compare FIG. 14A with FIG. 2A, FIG. 2B, and FIG. 2C). Using two FokI-Cascade complexes requires two PAM sequences in the proper orientation (FIG. 2A, FIG. 2B, and FIG. 2C), which can limit selection of proximal nucleic acid target sequences.

The length and/or composition of the linker polypeptide used to produce the fusion protein comprising a Cas subunit protein and an endonuclease (e.g., FokI), as well as the length and/or composition of the linker polypeptide used to produce the fusion protein comprising a dCas3* protein and an endonuclease, can be varied to modulate genome editing efficiency. Example 21A, Example 21B, Example 21C, and Example 21D describes the design and testing of multiple Cas3-FokI linker compositions and lengths and FokI-Cas8 linker compositions and lengths for modulation of genome editing efficiency.

Another embodiment of this aspect of the invention comprises an engineered Type I CRISPR-Cas effector complex (FIG. 13B: Cas7, Cas5, Cas8, Cse2, and Cas6; the dashed box around Cas6 indicates its interaction with the crRNA hairpin; the cRNA is illustrated as a black line comprising the hairpin) and a fusion protein comprising a dCas3* protein (FIG. 13B, dCas3*) and a functional domain (FIG. 13B, FP) (e.g., cytidine deaminase) connected by a linker polypeptide (FIG. 13B, Linker). The engineered Type I CRISPR-Cas effector complex can bind DNA and recruit the dCas3*-functional domain (e.g., cytidine deaminase) fusion protein. This embodiment can facilitate site-specific targeting of a nucleic acid target sequence for modification by, or interaction with, a functional domain. In the case of cytidine deaminase, an engineered Type I CRISPR-Cas effector complex and a fusion protein that comprises a dCas3* protein and cytidine deaminase can be used for site-specific base editing in a nucleic acid target sequence. FIG. 14B illustrates an example of an engineered Type I CRISPR-Cas effector complex (FIG. 14B, Cascade) comprising a fusion protein comprising a dCas3* protein (FIG. 14B, dCas3*) connected with a functional domain (FIG. 14B, FD) via a linker polypeptide (FIG. 14B, Linker), wherein the complex is bound to dsDNA (FIG. 14B, paired, horizontal dashed lines). In FIG. 14B, contact of the functional domain with dsDNA is facilitated. Binding of the Cascade complex involves a single PAM sequence (FIG. 14B, PAM, open box). FIG. 14C illustrates another example of an engineered Type I CRISPR-Cas effector complex (FIG. 14C, Cascade) comprising a fusion protein comprising a dCas3* protein (FIG. 14C, dCas3*) connected with a functional domain (FIG. 14C, FD) via a linker polypeptide (FIG. 14C, Linker), wherein the complex is bound to dsDNA (FIG. 14C, paired, horizontal dashed lines). Binding of the Cascade complex involves a single PAM sequence (FIG. 14C, PAM, open box). In FIG. 14C, contact of the functional domain with ssDNA is facilitated.

Additional functional domains and proteins that can be used to construct fusion proteins with Type I CRISPR-Cas subunit proteins are described in the present Specification and Examples. Linker polypeptide compositions and lengths for Cas3-linker polypeptide-functional domain fusion proteins can be evaluated following the guidance of Example 21A to Example 21D and the present Specification to evaluate effects on the performance of the functional domain.

Some embodiments of the present invention can use an engineered Type I CRISPR-Cas effector complex and a mCas3 protein, wherein the mCas3 protein comprises down-modulated helicase activity (e.g., the mCas3 protein, a Cas3 processivity mutant protein, has reduced movement along DNA relative to a wild-type Type I CRISPR Cas3 protein) or the mCas3 protein lacks helicase activity (e.g., the mCas3 protein is no longer a processive nuclease like wtCas3 protein, but the mCas3 protein retains nicking activity). The engineered Type I CRISPR-Cas effector complexes can bind DNA and then recruit the mCas3 protein. This embodiment can facilitate site-specific cleavage of genomic DNA.

Figure 44:
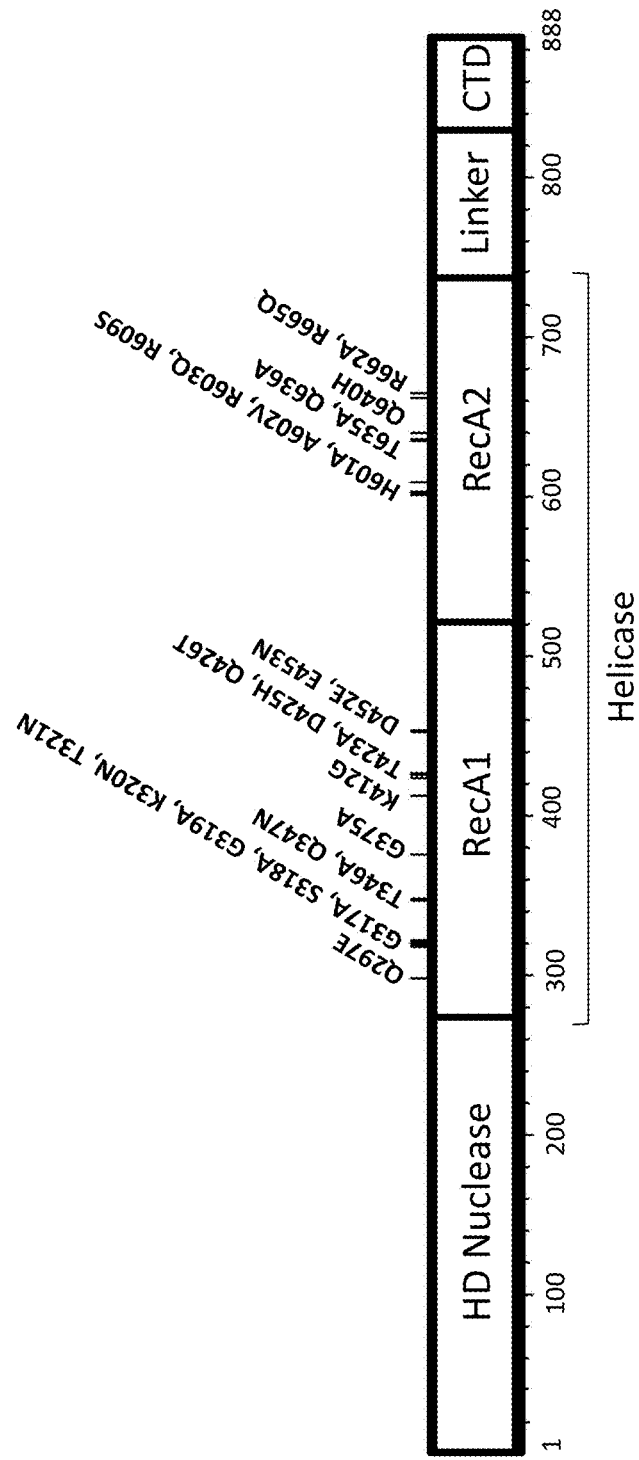
FIG. 44 shows a linear representation of the functional domains of the EcoCas3 protein and the relative locations of mutants made within the sequence.

Table 48 describes a number of mCas3 proteins, wherein the mutations made to the Cas3 protein affected the ATP binding/hydrolysis region of the helicase domain or the ssDNA path conserved region of the helicase domain. FIG. 44 shows a linear representation of the functional domains of the EcoCas3 protein and the relative locations of mutants made within the Cas3 coding sequence. In FIG. 44, the HD nuclease domain (amino acids 1-272), Helicase domain (RecA1 region, amino acids 273-521; RecA2 region, amino acids 522-737), Linker (amino acids 738-794), and C-terminal domain (CTD, amino acids 795-888) are indicated. Huo, Y., et. al., Nat. Struct. Mol. Biol. 9:771-777 (2014) provide a sequence conservation analysis with sequence alignments of the Cas3 family of proteins from *Thermobifida fusca* (accession code: Q47PJ0; SEQ ID NO:1869), *Saccharomonospora viridis* (C7MTA6; SEQ ID NO:1870), *Thermomonospora curvata* (D1A6Q2; SEQ ID NO:1922), *Streptomyces avermitilis* (Q825B5; SEQ ID NO:1925), *Streptomyces bottropensis* (M3DI13; SEQ ID NO:1923), *Thermus thermophilus* strain HD8 (Q53VY2; SEQ ID NO:1924) and *E. coli* (P38036; SEQ ID NO:1844). 24 different EcoCas3 protein variants with mutations in the ATP binding portion of the helicase domain or ssDNA loop binding domain were screened (Example 23A to Example 23C). Several mutants showed significantly more and/or position-shifted deletion classes within the amplicon window; a finding which supports that those mCas3 proteins had reduced processivity relative to wtCas3.

Example 23A to Example 23C describe such mCas3 proteins, wherein the average mCas3 protein-induced deletions are shorter relative to the average deletions generated with the corresponding wtCas3 protein. Such mCas3 proteins are useful for genome editing (e.g., in human cells). FIG. 45A, FIG. 45B, FIG. 45C, and FIG. 45D present data indicative of mCas3 proteins that, when associated with Cascade RNP complexes, generate shorter average deletion lengths relative to wtCas3 protein, in association with a Cascade RNP complex, when introduced into and expressed in human cells. In view of the teachings of the present Specification, one of ordinary skill in the art can make similar mutations in the corresponding regions of Cas3 proteins obtained from other species of bacteria in addition to *E. coli*.

Example 26A to Example 26C provide an additional example of a mCas3 protein useful for generating genomic deletions, wherein the average mCas3 protein-induced deletions are shorter relative to the average deletions generated with the corresponding wtCas3 protein. The data presented in the example support that an ATPase/helicase deficient variant of Cas3 from *Pseudomonas* sp. S-6-2 (mPseCas3 protein) can be used with PseCascade RNP complexes to generate deletions at the expected cleavage site (i.e., cleavage site localized deletion).

wtPseCas3 protein/PseCascade activity was further characterized. Additional experiments were performed using target-enrichment probes, which enable detection of large genomic deletions. Specifically, HEK293 cells were transfected with DNA templates encoding PseCascade RNP complex, wtPseCas3 protein, and a minimal CRISPR array directed to the TRAC locus essentially as described in Examples 26A to Example 26C. Target-enrichment probes were used to isolate and sequence genomic fragments; whereas in Example 26C, an amplicon window was used to identify the presence of deletions. The target-enrichment/sequencing method provided an unbiased view of larger deletions not provided by using an amplicon window to identify deletions. Overall, deletions evaluated using target-enrichment and sequencing of genomic fragments were found to be largely unidirectional, starting upstream of the wtPseCas3 protein initiation site. The deletions ranged from 1 bp to nearly 250 kb. In addition to providing a method of cutting genomic DNA and providing deletions of a given length, this method may be useful for generating large, random subsets of deletions at defined locations to probe regulatory/promoter regions of genes.

mCas3 proteins can comprise one or more mutations (e.g., combinations of the mutations as described in Table 48).

Control of deletion lengths was demonstrated for several mCas3 proteins. In some embodiments, mCas3 proteins of the present invention, in association with a Cascade complex comprising a guide polynucleotide, may provide average deletion lengths of between about 1 and about 600 base pairs, about 1 and about 500 base pairs, about 1 and about 400 base pairs, about 1 and about 300 base pairs, preferably between about 1 and about 250 base pairs, between about 1 and about 200 base pairs, or between about 1 and about 100 base pairs.

In some embodiments, wtCas3 proteins or mCas3 proteins can be fused to the various subunits of the Cascade complex to further control Cas3 average deletion lengths. Tethering to the Cascade complex may limit or prevent Cas3 protein or mCas3 protein movement along DNA, because as it will be fixed to the locus where the Cascade complex is bound. wtCas3 proteins or mCas3 proteins can be fused, typically with a linker polypeptide, to either the N- or C-terminal domain of protein components of a Cascade complex (e.g., for an EcoCascade complex fusions can be with EcoCas8, EcoCas6, or EcoCas5). NLS sequences can also be appended to the N-terminus of the fusion proteins. Examples of such constructs for *E. coli* Cascade protein components are presented in Table 12. These EcoCas3 fusion proteins also have NLS sequences appended to their N-termini.

TABLE 12

Plasmids Encoding EcoCascade Comprising Cas3 Fusion Proteins

| DNA sequences SEQ ID NO: | Corresponding protein sequences* SEQ ID NO: | Cas3 fusion, linker length, and Cascade complex gene | Fusion to N- or C- terminus of Cascade complex gene |
|---|---|---|---|
| 1875 | 1881 | Cas3-17aa-Cas8 fusion | N-terminal |
| 1876 | 1882 | Cas8-17aa-Cas3 fusion | C-terminal |
| 1877 | 1883 | Cas3-17aa-Cas5 fusion | N-terminal |
| 1878 | 1884 | Cas5-17aa-Cas3 fusion | C-terminal |
| 1879 | 1885 | Cas3-17aa-Cas6 fusion | N-terminal |
| 1880 | 1886 | Cas6-17aa-Cas3 fusion | C-terminal |

*protein sequence is the encoded polycistronic protein sequence

Embodiments of the present invention include an engineered Type I CRISPR mCas3 protein capable of reduced movement along DNA relative to a wild-type Type I CRISPR Cas3 protein (wtCas3 protein). In some embodiments, the mCas3 protein comprises about 90% or higher, preferably about 95% or higher, more preferably about 98% or higher sequence identity to the corresponding wtCas3 protein. The coding sequence for the mCas3 protein can comprise a nuclear localization signal covalently connected at the amino terminus, carboxy terminus, or both the amino and carboxy termini. A mCas3 protein can comprise one or more mutations that down-modulates helicase activity, wherein the engineered mCas3 protein retains nuclease activity (or at least a portion thereof) relative to the corresponding wtCas3 protein. Typically, DNA is dsDNA comprising a target region comprising a nucleic acid target sequence. When the wtCas3 protein is associated with a corresponding Cascade nucleoprotein complex ("Cascade NP complex/wtCas3 protein"; e.g., a Cascade RNP complex), and the Cascade NP complex comprises a guide comprising a spacer complementary to the nucleic acid target sequence, binding of the Cascade NP complex/wtCas3 protein to the nucleic acid target sequence facilitates cleavage in the target region of the DNA, typically resulting in a deletion in the target region; and the mCas3 protein when it is associated with the Cascade NP complex ("Cascade NP complex/mCas3 protein"; e.g., a Cascade RNP complex/mCas3 protein) and binds the nucleic acid target sequence facilitates cleavage in the target region of the DNA and results in a shorter average deletion length relative to the wtCas3 average deletion length.

In some embodiments, the one or more mutations in the mCas3 protein are substitutions of amino acids relative to the wtCas3 protein. In other embodiments, the one or more deletions comprise deletion or insertion of amino acids in the mCas3 protein coding sequence relative to the wtCas3 protein. The one or more mutations can be in either the RecA1 region or RecA2 region of the helicase domain. In one embodiment, the one or more mutations down-modulate binding of the mCas3 protein to ssDNA relative to the wtCas3 protein (e.g., a mutation affecting ssDNA loop binding and/or a mutation in the ssDNA path conserved region of the helicase domain). In additional embodiments, the one or more mutations down-modulate hydrolysis of ATP by the mCas3 protein relative to wtCas3 protein or down-modulate binding of ATP to the mCas3 protein relative to the wtCas3 protein. In a further embodiment, a mCas3 protein comprises combinations of one or more mutations that down-modulate binding of the mCas3 protein to ssDNA relative to the wtCas3 protein, down-modulate hydrolysis of ATP by the mCas3 protein or down-modulate binding of ATP to the mCas3 protein relative to the wtCas3 protein.

Further embodiments include the coding sequences for the mCas3 protein covalently connected to the amino terminus or carboxy terminus of coding sequences of a Cas protein of the Cascade nucleoprotein complex (e.g, a Cascade RNP complex). Such a Cas protein can be selected from the group consisting of Cse2, Cas8 protein, Cas7 protein, Cas6, and Cas5 protein.

In some embodiments, the wtCas3 protein is an *E. coli* Type 1 CRISPR Cas3 protein. In other embodiments, the wtCas3 protein is a wtCas3 protein selected from the group consisting of *Pseudomonas* sp. S-6-2, *Thermobifida fusca, Saccharomonospora viridis, Thermomonospora curvata, Streptomyces avermitilis, Streptomyces bottropensis, Thermus thermophilus, Vibrio cholera, Salmonella enterica, Geothermobacter* sp. EPR-M, *Methanocella arvoryzae* MRE50, and *Streptococcus thermophilus* (strain ND07).

For an *E. coli* Type 1 CRISPR wtCas3 protein, the one or more mutations can include, but are not limited to, D452H, A602V, or D452H and A602V.

In further embodiments, a cell comprises the DNA, wherein the cell can be a eukaryotic cell (e.g., a human cell).

In additional embodiments, the present invention includes polynucleotides comprising coding sequences for mCas3 proteins, expression cassettes comprising mCas3 protein coding sequences, plasmids comprising mCas3 protein coding sequences, and Cascade nucleoprotein complexes comprising mCas3 proteins.

In a ninth aspect, the present invention relates to methods of using engineered Type I CRISPR-Cas effector complexes.

In some embodiments, the present invention includes a method of binding a nucleic acid target sequence in a polynucleotide (e.g., dsDNA) comprising providing one or more engineered Type I CRISPR-Cas effector complexes for introduction into a cell or a biochemical reaction and introducing the engineered Type I CRISPR-Cas effector complexes into the cell or biochemical reaction, thereby facilitating contact of the engineered Type I CRISPR-Cas effector complexes with the polynucleotide. Contact of the complexes with the polynucleotide results in binding of the engineered Type I CRISPR-Cas effector complexes to the nucleic acid target sequence(s) in the polynucleotide.

In one embodiment, an engineered Type I CRISPR-Cas effector complex comprises a guide complementary to a nucleic acid target sequence in the polynucleotide. The engineered Type I CRISPR-Cas effector complex binds to a nucleic acid target sequence in the polynucleotide.

In a further embodiment, a first engineered Type I CRISPR-Cas effector complex comprises a guide complementary to a first nucleic acid target sequence in the polynucleotide and a second engineered Type I CRISPR-Cas effector complex comprises a guide complementary to a second nucleic acid target sequence in the polynucleotide. The first engineered 1 Type I CRISPR-Cas effector complex binds to a first nucleic acid target sequence and the second engineered Type I CRISPR-Cas effector complex binds to a second nucleic acid target sequence in the polynucleotide.

In yet another embodiment, an engineered Type I CRISPR-Cas effector complex comprises a guide complementary to a nucleic acid target sequence in the polynucleotide and further comprises a dCas3* fusion protein capable of associating with the complex. The engineered Type I CRISPR-Cas effector complex binds to a nucleic acid target sequence in the polynucleotide, and the effector complex comprises a dCas3* fusion protein associated with the complex.

Such methods of binding a nucleic acid target sequence can be carried out in vitro (e.g., in a biochemical reaction or in cultured cells; in some embodiments, the cultured cells are human cultured cells that remain in culture and are not introduced into a human); in vivo (e.g., in cells of a living organism, with the proviso that, in some embodiments, the organism is a non-human organism); or ex vivo (e.g., cells removed from a subject, with the proviso that, in some embodiments, the subject includes a human subject, and in other embodiments the subject is a non-human subject).

A variety of methods are known in the art to evaluate and/or quantitate interactions between nucleic acid sequences and polypeptides including, but not limited to, the following: immunoprecipitation (ChIP) assays, DNA electrophoretic mobility shift assays (EMSA), DNA pull-down assays, and microplate capture and detection assays. Commercial kits, materials, and reagents are available to practice many of these methods and, for example, can be obtained from the following suppliers: Thermo Scientific (Wilmington, DE), Signosis (Santa Clara, CA), Bio-Rad (Hercules, CA), and Promega (Madison, WI). A common approach to detect interactions between a polypeptide and a nucleic acid sequence is EMSA (see, e.g., Hellman L. M., et al., Nature Protocols 2:1849-1861 (2007)).

In another embodiment, the present invention includes a method of cutting a nucleic acid target sequences in a polynucleotide (e.g., a single-strand cut in dsDNA or double-strand cut in dsDNA) comprising providing one or more engineered Type I CRISPR-Cas effector complexes for introduction into a cell or biochemical reaction, and introducing the engineered Type I CRISPR-Cas effector complexes into the cell or biochemical reaction, thereby facilitating contact of the engineered Type I CRISPR-Cas effector complexes with the polynucleotide.

In one embodiment, a first engineered Type I CRISPR-Cas effector complex comprising a guide complementary to a first nucleic acid target sequence in the polynucleotide and a first nuclease domain (e.g., FokI) (FIG. 15A, Cascade1, solid outline box, connected via a linker polypeptide, curved black line, to the first nuclease domain, represented as a circular sector), and a second engineered Type I CRISPR-Cas effector complex comprising a guide complementary to a second nucleic acid target sequence in the polynucleotide and a second nuclease domain (e.g., FokI) (FIG. 15A, Cascade 2, dash outline box, connected via a linker polypeptide, curved black line, to the second nuclease domain, represented as a circular sector) are introduced into the cell or biochemical reaction. The first engineered Type I CRISPR-Cas effector complex (FIG. 15B, Cascade1) binds to the first nucleic acid target sequence in dsDNA (FIG. 15B, dsDNA represented by paired, horizontal black lines) and the first nuclease domain cleaves the first strand of a dsDNA (FIG. 15C, Cascade1), and the second engineered Type I CRISPR-Cas effector complex (FIG. 15B, Cascade2) binds to the second nucleic acid target sequence in dsDNA and the second nuclease domain cleaves the second strand of a dsDNA. The binding of the engineered Type I CRISPR-Cas effector complexes results in cutting of the nucleic acid target sequences in the polynucleotide (e.g., a dsDNA) by the engineered Type I CRISPR-Cas effector complexes.

In an additional embodiment, a first engineered Type I CRISPR-Cas effector complex comprising a guide complementary to a first nucleic acid target sequence in the polynucleotide, a second engineered Type I CRISPR-Cas effector complex comprising a guide complementary to a second nucleic acid target sequence in the polynucleotide, and a Cas3 nickase (e.g., an ATPase-deficient Cas3 variant having only nickase activity) are introduced into the cell or biochemical reaction. The first engineered Type I CRISPR-Cas effector complex binds to the first nucleic acid target sequence in dsDNA, the Cas3 nickase protein associates with the first complex, and cleaves the first strand of a dsDNA, and the second engineered Type I CRISPR-Cas effector complex binds to the second nucleic acid target sequence in dsDNA, the Cas3 nickase protein associates with the second complex, and cleaves the second strand of a dsDNA. The binding of the engineered Type I CRISPR-Cas effector complexes with associated Cas3 nickase proteins results in cutting of the nucleic acid target sequences in the polynucleotide (e.g., a dsDNA) by the engineered Type I CRISPR-Cas effector complexes. Example 25A, Example 25B, and Example 25C present data that demonstrate Cascade RNP complexes comprising Cas3 ATPase deficient mutant proteins can induce targeted genomic deletions through paired nicking. This paired nicking can facilitate targeted deletions in the genomes of host cells (e.g., human cells).

In another embodiment, an engineered Type I CRISPR-Cas effector complex comprising a guide complementary to a nucleic acid target sequence in the polynucleotide and a first nuclease domain (e.g., FokI) (FIG. 16A, Cascade; dash outline box, connected via a linker polypeptide, curved black line, to the first nuclease domain, represented as a circular sector), and a dCas3*-second nuclease domain (e.g., FokI) fusion protein (FIG. 16A, dCas3; solid outline box, connected via a linker polypeptide, curved black line, to the second nuclease domain, represented as a circular sector) capable of associating with the complex are introduced into the cell or biochemical reaction. The engineered Type I CRISPR-Cas effector complex (FIG. 16B, Cascade) binds to a nucleic acid target sequence in dsDNA (FIG. 16B, paired, horizontal, black lines) and cleaves the first strand of a dsDNA (FIG. 16C, Cascade), and the dCas3* fusion protein associates with the Cascade RNP complex (FIG. 16B, dCas3*) and cleaves the second strand of the dsDNA (FIG. 16C, dCas3*).

In a further embodiment, an engineered Type I CRISPR-Cas effector complex comprising a guide complementary to a target region comprising a nucleic acid target sequence in the polynucleotide and Cas3 protein (e.g., a Cas3 protein or a mCas3 protein) capable of associating with the complex are introduced into the cell or biochemical reaction. The engineered Type I CRISPR-Cas effector complex binds to a nucleic acid target sequence in dsDNA, the Cas3 protein (e.g., a Cas3 protein or a mCas3 protein) associates with the complex and cleaves at least one strand of the dsDNA in the target region. In some embodiments, cleavage of the dsDNA by the mCas3 protein results in a deletion in the target region of the dsDNA. This method can be used to make long range deletions of a specific length and can be useful for creation of gene knock-outs or knock-ins. In some embodiments, the Cas3 protein (e.g., a Cas3 protein or a mCas3 protein) can be fused to a Cascade complex subunit protein (e.g., a Cas7 protein, a Cas8 protein, a Cas5 protein, a Cse2 protein). Example 23A to Example 23C describe embodiments of mCas3 proteins.

In another embodiment, the present invention relates to using Type I CRISPR-Cas effector complexes, wherein a nuclease domain is fused to a Cascade complex protein (see, e.g., Example 11A, Table 38) or to a dCas3* protein (e.g., a dCas3* protein fused to a DNase) to delete nucleic acid target sequences. This method can be used to make cuts as well as deletions in a target region of dsDNA and can be useful for creation of gene knock-outs. In some embodiments, the nuclease domain can be fused to a Cascade complex subunit protein such as a Cas7 protein, a Cas8 protein, a Cas5 protein, a Cse2 protein.

Methods of cutting a nucleic acid target sequence in a polynucleotide can further comprise introduction of a donor polynucleotide into a cell to facilitate incorporation of at least a portion of the donor polynucleotide into gDNA of the cell.

Figures 17A, 17B, 17C:
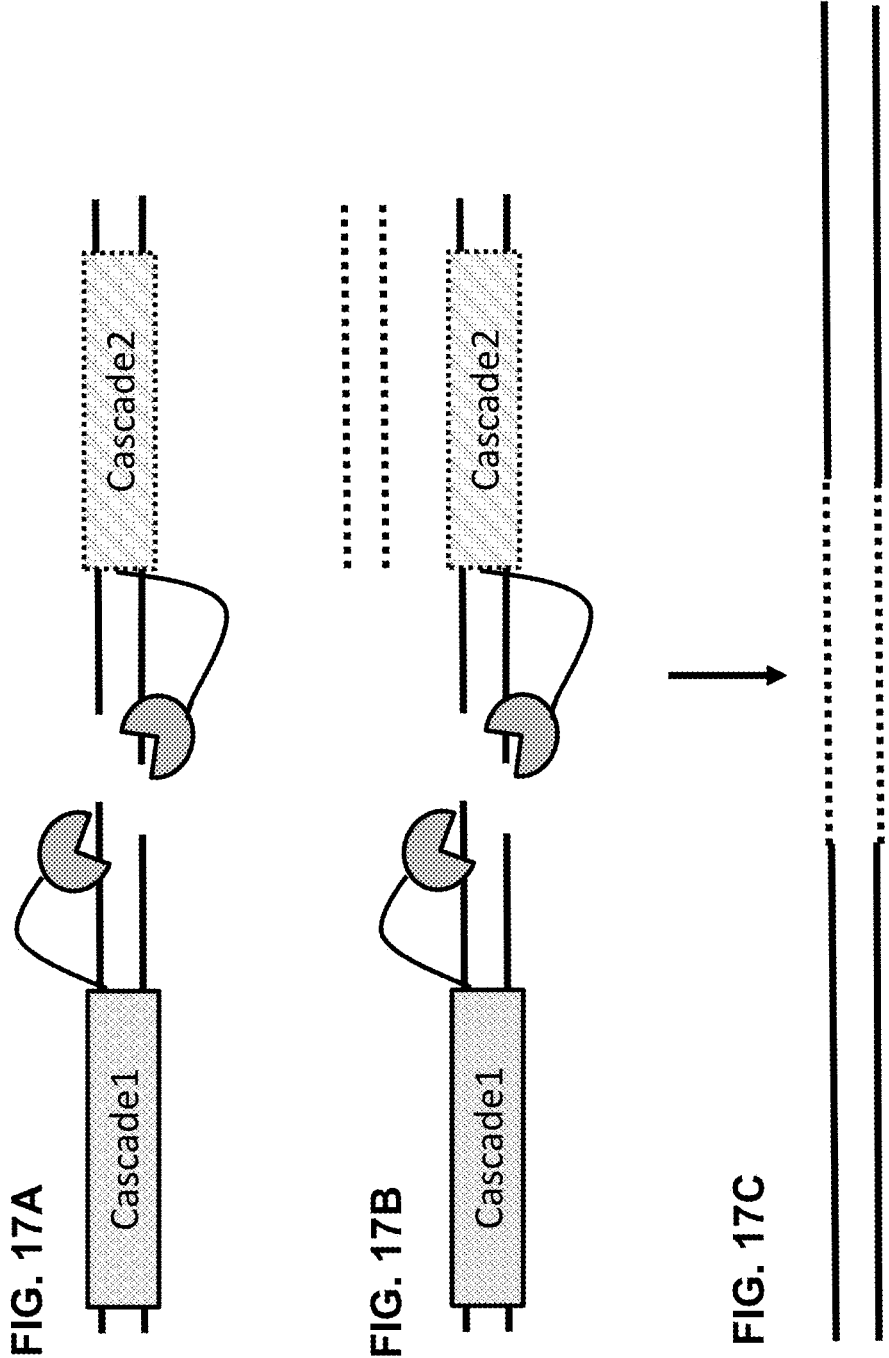

FIG. 17A illustrates an example of both strands of a dsDNA (FIG. 17A, paired, dark horizontal lines) being cleaved by a first engineered Type I CRISPR-Cas effector complex comprising a guide complementary to a first nucleic acid target sequence in the polynucleotide (FIG. 17A, Cascade1) and a first nuclease domain (e.g., FokI) (FIG. 17A, linker polypeptide illustrated as a bent line connecting Cascade1 and a grey, circular sector), and a second engineered Type I CRISPR-Cas effector complex comprising a guide complementary to a second nucleic acid target sequence in the polynucleotide (FIG. 17A, Cascade 2) and a second nuclease domain (e.g., FokI) (FIG. 17A, linker polypeptide illustrated as a bent line connecting Cascade2 and a grey, circular sector). FIG. 17B illustrates a donor polynucleotide (FIG. 17B, paired, dashed lines shown above Cascade2) comprising homology arms complementary to DNA sequences adjacent the double-strand cut site (FIG. 18B, Donor, dashed lines). FIG. 17C illustrates incorporation of a portion of the donor polynucleotide (FIG. 17C, paired, dashed lines connecting the paired, dark, horizontal lines representing dsDNA) in the region of the double-strand cut site. Incorporation of the donor polynucleotide is mediated by cellular DNA repair mechanisms (e.g., HDR) (FIG. 17B to FIG. 17C, downward pointing, vertical arrow represents cellular DNA repair mechanisms).

In other embodiments, an engineered Type I CRISPR-Cas effector complex comprising a guide complementary to a first nucleic acid target sequence in a polynucleotide and a first nuclease domain can be paired with a second component comprising a second nuclease domain, wherein the second component is capable of binding to a second nucleic acid target sequence in the polynucleotide. Examples of such second components include, a transcription activator-like effector nuclease (TALEN) comprising the second nuclease domain, a zinc finger nuclease (ZFN) comprising the second nuclease domain, or a dCas9/NATNA complex comprising the second nuclease domain.

In one embodiment, a region of a target polynucleotide (e.g., gDNA) can be deleted using a combination of a Cascade complex comprising a guide complementary to a first nucleic acid target sequence in the target polynucleotide and a dCas9/NATNA complex wherein the NATNA comprises a spacer sequence complementary to a second nucleic acid target sequence in the target polynucleotide. The first and second nucleic acid target sequences are selected to flank the nucleic acid target sequence targeted for deletion. A Cas3 protein comprising an active endonuclease activity associates with the Cascade complex and then progressively deletes a single strand of the dsDNA comprising the nucleic acid target sequence targeted for deletion. When the Cas3 protein collides with the dCas9/NATNA complex (i.e., a "roadblock"), the Cas3 nuclease activity can be stopped at the second nucleic acid target sequence by the dCas9/NATNA complex. FIG. 21A to FIG. 21D illustrate an example of a Cas3 deletion of a nucleic acid target sequence. FIG. 21A shows a dsDNA (FIG. 21A, paired, horizontal, black lines) comprising nucleic acid target sequence 1 (FIG. 21A, NATS1) and nucleic acid target sequence 2 (FIG. 21A, NATS2) that flank the nucleic acid target sequence targeted for deletion. FIG. 21A shows the Cascade complex comprising a guide complementary to NATS1 (FIG. 21A, Cascade; black line framed rectangle), the Cas3 protein (FIG. 21A, Cas3; grey circular sector), and the dCas9/NATNA complex comprising a spacer complementary to NATS2 (FIG. 21A, dCas9; dashed line framed rectangle). FIG. 21B shows binding of the Cascade complex to NATS1, association of the Cas3 protein with the Cascade complex, and binding of the dCas9/NATNA complex to NATS2. FIG. 21C illustrates the progressive deletion by Cas3 of a single strand of the nucleic acid target sequence targeted for deletion. FIG. 21D shows the dissociation of the Cas3 protein from the dsDNA at the position of the dCas9/NATNA complex bound to NATS2. Example 24A to Example 24D present data that support the use of protein roadblocks to control the length of deletions mediated by Cas3 protein associated with Cascade nucleoprotein complexes; thus, providing a method to use Cas3 protein associated with Cascade nucleoprotein complexes to facilitate formation of deletions having a defined length in the gDNA of cells (e.g., human cells).

Figures 22A, 22B, 22C, 22D:
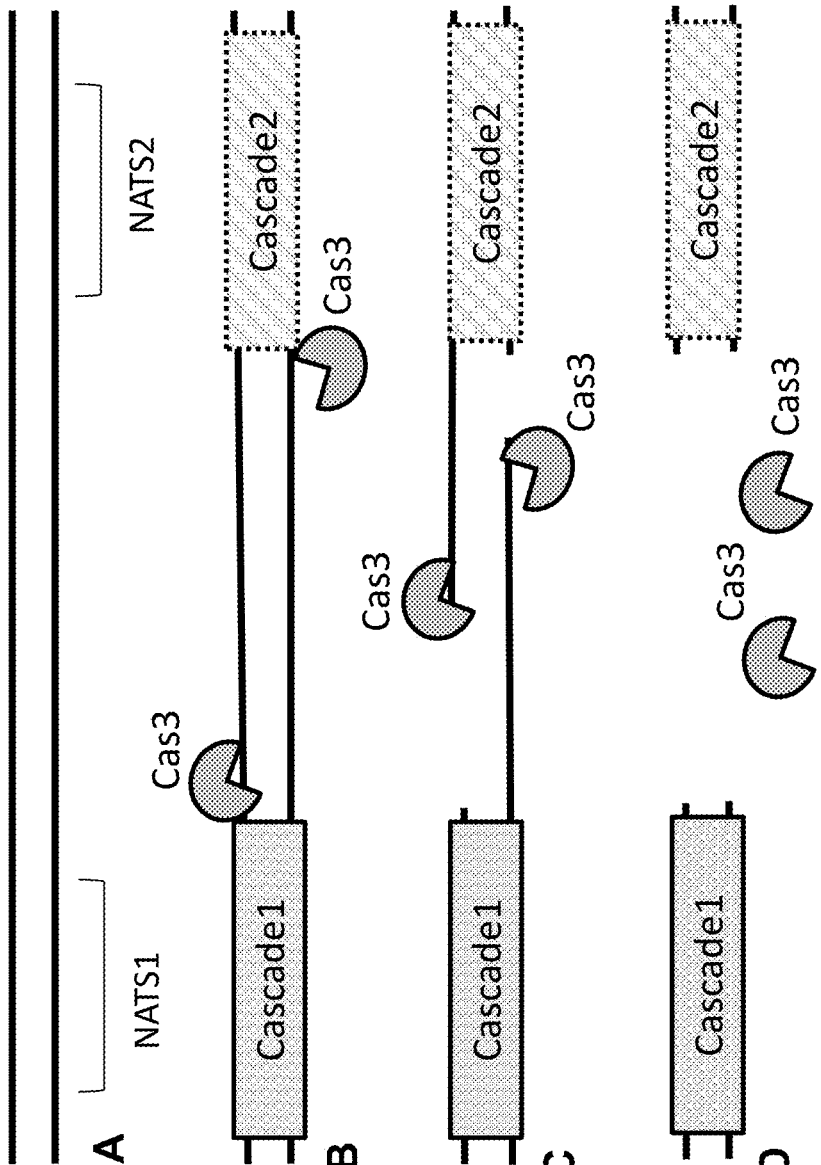

In another embodiment, a region of a target polynucleotide (e.g., gDNA) can be deleted using a combination of a first Cascade complex comprising a guide complementary to a first nucleic acid target sequence in the target polynucleotide and a second Cascade complex comprising a guide complementary to a second nucleic acid target sequence in the target polynucleotide. The first and second nucleic acid target sequences are selected to flank the nucleic acid target sequence targeted for deletion. Cas3 proteins comprising active endonuclease activity associate with each Cascade complex and then progressively delete both strands of the nucleic acid target sequence targeted for deletion. When each Cas3 protein collides with one of the Cascade complexes, the Cas3 nuclease activity can be stopped at the first and second nucleic acid target sequences by the Cascade complexes. FIG. 22A to FIG. 22D illustrate an example of a Cas3 deletion of both strands of a nucleic acid target sequence. FIG. 22A shows a dsDNA (FIG. 22A; paired, horizontal, black lines) comprising nucleic acid target sequence 1 (FIG. 22A, NATS1) and nucleic acid target sequence 2 (FIG. 22A, NATS2) that flank the nucleic acid target sequence targeted for deletion. FIG. 22A shows the first Cascade complex comprising a guide complementary to NATS1 (FIG. 22A, Cascade1; black line framed rectangle), the Cas3 proteins (FIG. 22A, Cas3; grey circular sector), and the second Cascade complex comprising a guide complementary to NATS2 (FIG. 22A, Cascade2; dash line framed rectangle). FIG. 22B shows binding of the Cascade complexes to NATS1 and NATS2, as well as association of the Cas3 proteins with the Cascade complexes. FIG. 22C illustrates the progressive deletion resulting from movement along the DNA and nuclease degradation by Cas3 of both strands of the nucleic acid target sequence targeted for deletion. FIG. 22D shows the dissociation of the Cas3 proteins from the dsDNA at the positions of the Cascade complexes bound to NATS1 and NATS2.

In a further embodiment, a Cascade complex can be modified such that it is not capable of binding to a Cas3 protein, and such a modified Cascade complex can act as a roadblock essentially in the same manner as illustrated in FIG. 21A to FIG. 21D to stop progressive degradation of DNA by a catalytically active Cas3 in association with a Cascade RNP complex. Additional site-specific binding proteins (e.g., transcription activator-like effectors (TAL), or zinc-finger (ZnF) DNA binding proteins) can be used as roadblocks in a similar way.

In some embodiments, the nucleic acid target sequence is dsDNA (e.g., genomic) DNA. In some embodiments, the nucleic acid target sequence is double-stranded and one or both of the strands is cut. Such methods of cutting a nucleic acid target sequence can be carried out in vitro, in vivo, or ex vivo.

As described above, in some embodiments the present invention relates to introducing one or more engineered Type I CRISPR-Cas effector complexes into a host cell to facilitate cleavage of a nucleic acid target sequence in dsDNA in the presence of a donor polynucleotide, wherein the one or more engineered Type I CRISPR-Cas effector complexes generate a cut site (or cut site and associate deletion) in a target region comprising the nucleic acid target sequence of the host cell DNA thereby facilitating insertion of at least a portion of the donor polynucleotide into the target region. In some embodiments, the cut site is a double-stranded break in the target region (e.g., when using two engineered Type I CRISPR-Cas effector complexes each comprising a spacer and a fusion protein comprising a Cas protein and an endonuclease (e.g., a FokI) or two engineered Type I CRISPR-Cas effector complexes each comprising a spacer that associate with a Cas3 protein or a mCas3 protein). In some embodiments, the cut site is a single-stranded break in the target region (e.g., when using a Type I CRISPR-Cas effector complex associated with a mCas3 protein). In other embodiments, the cut site is a deletion in the target region (e.g., when using a Type I CRISPR-Cas effector complex associated with a Cas3 or mCas3 protein).

In order to demonstrate homology directed repair (HDR), a minimal CRISPR array was designed to target the FokI-PseCascade RNP complex to four loci (WDR92, B2M, CCR5, and TRAC) in the human genome. The minimal CRISPR arrays were generated with PCR-based assembly using three oligonucleotides (SEQ ID NO:1513 to SEQ ID NO:1515; Example 20A) and a unique primer encoding a "repeat-spacer-repeat-spacer-repeat" sequence, wherein the first and second spacers directed FokI-PseCascade RNP complexes to adjacent nucleic acid target sequences to enable FokI dimerization and genome cleavage (i.e., generation of a cut site).

For each HDR insertion site in a target region comprising a cut site, in this case overlapping with the cut site, cells were transfected with the following: 3 µg of vector encoding FokI-PseCascade complex protein components comprising FokI fused to the N-terminus of Cas8 with an NLS connected to the N terminus of the FokI, 150 ng of the minimal CRISPR arrays, and 0-60 pmol of a single-stranded oligodeoxynucleotide (ssODN) template donor polynucleotide for HDR. The ssODN comprised homology arms, each homology arm was 75 nucleotides, and the two arms were symmetrically located around the cut site. The donor polynucleotide further comprised phosphorothioate bonds at the 3' terminal nucleotides of homology arms to reduce or prevent cellular degradation of the donor polynucleotide. 5' of the phosphothiorate bonds, the donor polynucleotide further comprised an insertion sequence of "TAATAAT" to insert two stop codons, and increase the interspacer distance in the repaired chromosome, thus impeding FokI-PseCascade RNP complex re-cleavage.

Transfection was carried out in HEK293 cells essentially as described in Example 20B with the exception that a ssODN was included in the mixture to enable HDR. Several days after transfection, gDNA was purified from the cells, treated with exonuclease to remove any residual ssODN that could contaminate subsequent PCRs, and then used as template for amplification to measure donor insertion. Deep sequencing analysis was carried out essentially as described in Example 20C. The percentage of mutant reads out of total reads from this experiment are presented in Table 13 (the first column is pmol of ssODN):

TABLE 13

| | Percentage of Mutant Reads | | | | | | | | | | | |
|---|---|---|---|---|---|---|---|---|---|---|---|---|
| | WDR92 | | | B2M | | | CCR5 | | | TRAC | | |
| | Rep1 | Rep2 | Rep3 | Rep1 | Rep2 | Rep3 | Rep1 | Rep2 | Rep3 | Rep1 | Rep2 | Rep3 |
| 0 | 11.6 | 9.54 | 9.93 | 3.46 | 3.22 | 5.88 | 7.02 | 4.94 | 8.75 | 3.76 | 2.94 | 3.38 |
| 20 | 11 | 8.82 | 12.6 | 0.99 | 4.99 | 2.94 | 5.56 | 6.69 | 12.9 | 2.92 | 3.72 | 3.8 |
| 40 | 10.1 | 9.54 | 11.3 | 1.97 | 2.79 | 0 | 5.44 | 0.24 | 5.13 | 3.69 | 3.99 | 4.97 |
| 60 | 12.6 | 10.4 | 11.5 | 0.94 | 1.01 | 1.08 | n/a | 5.95 | 8.5 | 4 | 3.48 | n/a |

The percentage of mutant reads indicates the mutant reads that contain indels resulting from non-homologous end-joining as well as insertions of the "TAATAAT" HDR sequence.

The percentage of HDR reads, containing only the "TAATAAT" insertion sequence, out of total mutants reads from this experiment are presented in Table 14 (the first column is pmol of ssODN):

TABLE 14

Percentage of HDR Reads

| | WDR92 | | | B2M | | | CCR5 | | | TRAC | | |
|---|---|---|---|---|---|---|---|---|---|---|---|---|
| | Rep1 | Rep2 | Rep3 | Rep1 | Rep2 | Rep3 | Rep1 | Rep2 | Rep3 | Rep1 | Rep2 | Rep3 |
| 0 | 0 | 0 | 0 | 0 | 0 | 0 | 0 | 0 | 0 | 0 | 0 | n/a |
| 20 | 23.03 | 10.72 | 9.68 | 14.26 | 0.11 | 14.38 | 7.07 | 3.94 | 0.22 | 21.37 | 0 | 9.14 |
| 40 | 16.38 | 13.7 | 4.83 | 0 | 16.5 | 0 | 2.42 | 0 | 10.54 | 2.1 | 0 | 13.23 |
| 60 | 5.5 | 11.98 | 7.31 | 0 | 12.28 | 5 | n/a | 1.9 | 13.87 | 0.79 | 7.53 | 9.38 |

As can be seen from the data, cleavage of dsDNA by Cascade RNP complexes enables HDR and incorporation of donor polynucleotide at multiple loci across the human genome.

In yet another embodiment, the present invention includes a method of modifying one or more nucleic acid target sequences in a polynucleotide (e.g., DNA) in a cell or biochemical reaction comprising providing one or more engineered Type I CRISPR-Cas effector complexes (e.g., comprising a Cas subunit protein-cytidine deaminase fusion protein) for introduction into the cell or the biochemical reaction, and introducing the engineered Type I CRISPR-Cas effector complex(es) into the cell or biochemical reaction, thereby facilitating contact of the engineered Type I CRISPR-Cas effector complex(es) with the polynucleotide resulting in binding of the engineered Type I CRISPR-Cas effector complex(es) to the nucleic acid target sequence(s) in the polynucleotide that facilitates mutation of the nucleic acid target sequence(s) (e.g., C-to-T, G-to-A, A-to-G, and T-to-C). FIG. 18A to FIG. 18D illustrate an example of using a Cascade complex comprising a Cas subunit protein-linker polypeptide-cytidine deaminase fusion protein (Cascade/CD complex) to mutate a target nucleotide in gDNA of a cell (FIG. 18A, paired, dark horizontal lines, with a "C" for cytosine and a "G" for guanine). The Cascade/CD complex (FIG. 18A; "Cascade" with linker polypeptide illustrated as a bent line connecting Cascade and the cytidine deaminase "CD" represented as a grey, circular sector) is introduced into the cell. The Cascade/CD complex comprises a guide complementary to a DNA target sequence adjacent a target cytosine (FIG. 18B, "C"). In FIG. 18B, the Cascade/CD complex binds the DNA target sequence and the cytidine deaminase converts the cytosine (FIG. 18B, "C") to a uracil (FIG. 18C, "U"). Cellular repair mechanisms can then repair the uracil to a thymidine, and change the mismatched guanidine to adenine (FIG. 18C to FIG. 18D, downward pointing, vertical arrow represents cellular DNA repair mechanisms).

In yet another embodiment, the present invention includes methods of modulating in vitro or in vivo transcription, for example, transcription of a gene comprising regulatory element sequences. Such methods comprise providing one or more engineered Type I CRISPR-Cas effector complexes (e.g., comprising a Cas subunit protein-transcription factor fusion protein) for introduction into the cell or the biochemical reaction, and introducing the engineered Type I CRISPR-Cas effector complex(es) into the cell or biochemical reaction, thereby facilitating contact of the engineered Type I CRISPR-Cas effector complex(es) with the regulatory element sequences resulting in binding of the engineered Type I CRISPR-Cas effector complex(es) to the regulatory element sequences thereby facilitating modulating in vitro or in vivo transcription of the gene comprising the regulatory element sequences.

Figures 19A, 19B:
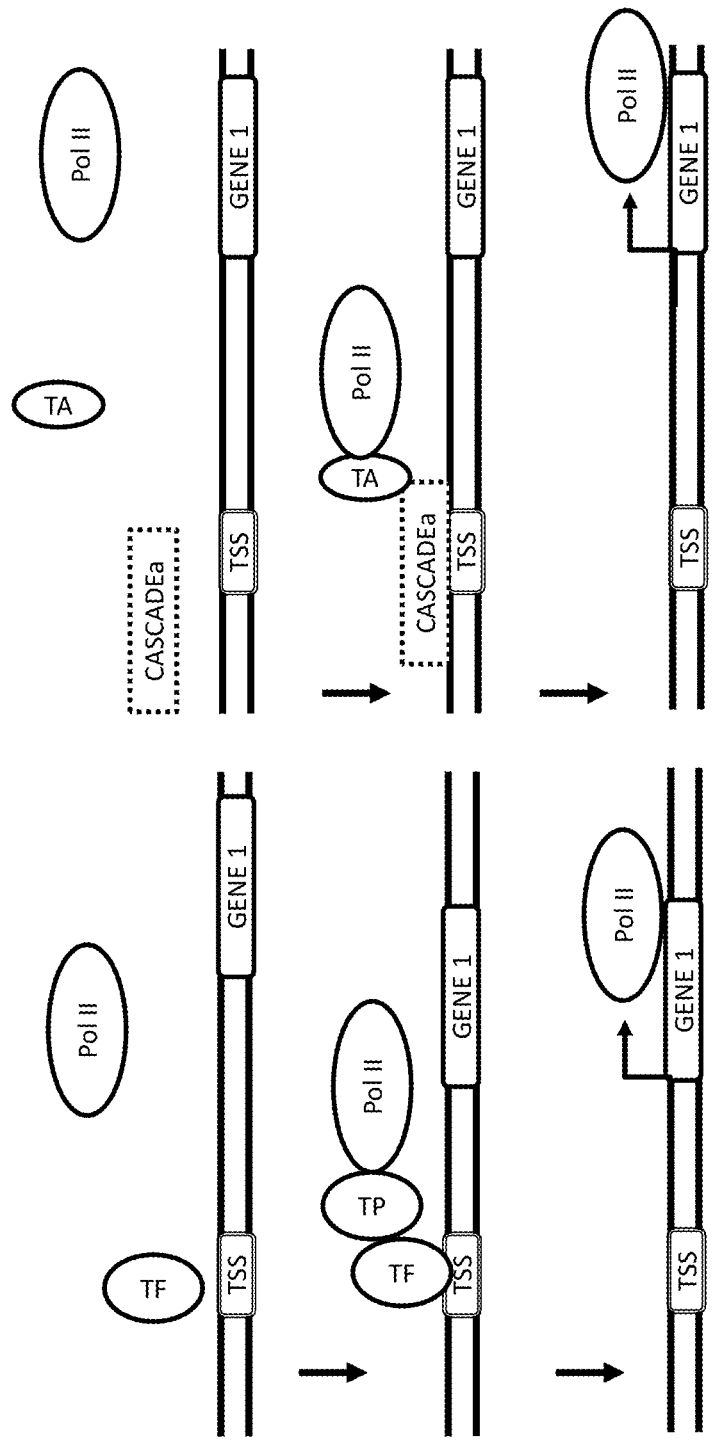

FIG. 19A and FIG. 19B present general illustrations of examples for the transcriptional activation of a generic gene ("GENE1"). FIG. 19A provides an overview of transcriptional regulation of an endogenous gene in a eukaryotic cell. In FIG. 19A, the two dark parallel lines represent double-stranded DNA, the location of Gene 1 (FIG. 19A, GENE 1) is indicated, as well as the transcriptional start site (FIG. 19A, TSS) associated with Gene 1. In the first panel of FIG. 19A, a transcription factor (FIG. 19A, TF) that is needed for the transcriptional activation of Gene 1 and polymerase II (FIG. 19A, Pol II) are illustrated as not yet associated with Gene1-TSS. The second panel illustrates association of the TF with its cognate TSS. The TF then recruits a transcription activation protein (FIG. 19A, TP) that then recruits RNA polymerase II (FIG. 19A, Pol II). Typically, in eukaryotes the TF factor and the TP form a complex comprising multiple proteins and possibly other molecules. The third panel illustrates the resulting transcription of Gene 1 by Pol II (FIG. 19A, bent arrow at the end of GENE 1 indicates the direction of transcription). This type of transcriptional activation is typically dependent on TF(s) that are specific to the expression of a gene(s). FIG. 19B presents an illustration of one embodiment of the present invention, wherein a Cascade complex is engineered to comprise a protein or factor (FIG. 19B, CASCADEa) that attracts one or more components in the cells responsible for transcriptional activation (Transcriptional Activation factor; FIG. 19B, TA). An example of one such protein or factor is the protein VP64. CASCADEa comprises a guide that is capable of binding at or near the TSS (FIG. 19B, TSS). In FIG. 19B, the two dark parallel lines represent double-stranded DNA, the location of Gene 1 (FIG. 19B, GENE 1) is indicated, as well as the transcriptional start site (TSS) associated with Gene 1. In the first panel of FIG. 19B, CASCADEa and polymerase II (FIG. 19B, Pol II) are illustrated as not yet associated with Gene1-TSS. The second panel illustrates association of CASCADEa with its target, the TSS. The CASCADEa then recruits a transcription activation protein (FIG. 19B, TA) that then recruits RNA polymerase II (FIG. 19B, Pol II). The third panel illustrates the resulting transcription of Gene 1 by Pol II (FIG. 19B, bent arrow at the end of GENE 1 indicates the direction of transcription). One advantage of this embodiment of the present invention is that transcriptional activation of a gene is not dependent on endogenous transcription factors that bind to the TSS of the gene, rather the TSS of a gene can be targeted by selection of an appropriate Cascade guide.

FIG. 20A and FIG. 20B present a general illustration of an example for the transcriptional repression of a generic gene (FIG. 20A, GENE 1) using a Cascade complex comprising a Cas subunit protein-KRAB domain fusion and a guide (FIG. 20A, CASCADEi with linker polypeptide illustrated as a bent line connecting Cascade and a circular element representing a KRAB domain) complementary to regulatory sequences (FIG. 20A, promoter) associated with GENE 1. Binding of CASCADEi to the regulatory sequences (FIG. 20B) results in transcriptional repression of GENE 1 (FIG. 20B, dark line ending in X represents transcriptional repression).

The engineered Type I CRISPR-Cas effector complexes, as described herein, can be incorporated into a kit. In some embodiments, a kit includes a package with one or more containers holding the kit elements, as one or more separate compositions or, optionally if the compatibility of the components allows, as admixture. In some embodiments, a kit also comprises one or more of the following excipients: a buffer, a buffering agent, a salt, a sterile aqueous solution, a preservative, and combinations thereof. Illustrative kits can comprise one or more engineered Type I CRISPR-Cas effector complexes and one or more excipients, or one or more nucleic acid sequences encoding one or more components of engineered Type I CRISPR-Cas effector complexes.

Furthermore, kits can further comprise instructions for using engineered Type I CRISPR-Cas effector complex compositions.

Another aspect of the invention relates to methods of making or manufacturing one or more engineered Type I CRISPR-Cas effector complexes, or components thereof. In one embodiment, a method of making or manufacturing comprises production of engineered Type I CRISPR-Cas effector complexes in a cell and purification of the engineered Type I CRISPR-Cas effector complexes from cell lysates.

Engineered Type I CRISPR-Cas effector complex compositions can further comprise a detectable label, such as a moiety that can provide a detectable signal. Examples of detectable labels include, but are not limited to, an enzyme, a radioisotope, a member of a specific binding pair, a fluorophore (FAM), a fluorescent protein (green fluorescent protein (GFP), red fluorescent protein, mCherry, tdTomato), a DNA or RNA aptamer together with a suitable fluorophore (enhanced GFP (eGFP), "Spinach"), a quantum dot, an antibody, and the like. A large number and variety of suitable detectable labels are well-known to one of ordinary skill in the art.

In some embodiments, engineered Type I CRISPR-Cas effector complexes (i.e., nucleoprotein particles) can be introduced into cells by methods including, but not limited to, nucleofection, gene gun delivery, sonoporation, cell squeezing, lipofection, or the use of other chemicals, cell penetrating peptides, and the like. In other embodiments, coding sequences for one or more components of engineered Type I CRISPR-Cas effector complexes and associated proteins can be introduced into cells using vector systems, expression cassettes comprising DNA sequences encoding one or more of the components, as well as one or more RNA molecules (e.g., mRNA) comprising expression cassettes comprising RNA sequences encoding one or more of the components.

One embodiment of the present invention relates to the use of engineered Type I CRISPR-Cas effector complexes to produce recombinant cells (e.g., modified lymphocytes). The method typically comprises facilitating contact of a dsDNA, comprising a target region comprising a nucleic acid target sequence in a host cell with one or more engineered Class 1 Type I CRISPR-Cas effector complexes of the present invention. Contact of the engineered Class 1 Type I CRISPR-Cas effector complex with the nucleic acid target sequence results in binding of the engineered Class 1 Type I CRISPR-Cas effector complex with the target region comprising the nucleic acid target sequence, cleavage of the target region comprising the nucleic acid target sequence, and modification of the dsDNA in the target region, thus producing the recombinant cell. In some embodiments, the dsDNA comprises more than one nucleic acid target sequence and engineered Class 1 Type I CRISPR-Cas effector complexes comprising spacer sequences complementary to each nucleic acid target sequence are used to bind, cut, and modify each nucleic acid target sequence. In some embodiments, the modification of the target region is an insertion, a deletion, or insertion and deletion. Methods of cutting a nucleic acid target sequences in a polynucleotide (e.g., a single-strand cut in dsDNA or double-strand cut in dsDNA) comprising providing one or more engineered Type I CRISPR-Cas effector complexes for introduction into a cell are described above.

Embodiments of the present invention include producing recombinant cells using one or more engineered Class 1 Type I CRISPR-Cas effector complexes, wherein the gDNA of the recombinant cells comprise knock-out mutations (e.g., of the B2M gene and/or PDCD1 gene), knock-ins (e.g., editing at the TRAC locus and integration of a CAR from a donor polynucleotide), or combinations thereof. In some embodiments, cleavage at a nucleic acid target sequence in a TRAC gene of gDNA is followed by incorporation of at least a portion of a donor polynucleotide at the nucleic acid target sequence. The donor polynucleotide can comprise a CAR construct, wherein the CAR is inserted in the nucleic acid target sequence.

Recombinant cells made by methods of the present invention can be used in adoptive cell transfer (ACT). ACT is a rapidly emerging immunotherapy approach that uses transplanted immune cells to treat cancer. ACT is the transfer of cells into a patient. Most commonly, the immune cells are derived from the immune system with the goal of improving immune function. In autologous cancer immunotherapy, immune cells or stem cells are harvested from a patient and expanded by culturing ex vivo to large quantities and then returned to the patient. The immune cells or stem cells can be modified in a variety of ways in culture (e.g., use of genome editing to incorporate a CAR into the genome of a T cell). In some embodiments, lymphocytes for modification are isolated from a subject, modified, and then reintroduced into the same subject. This technique is known as autologous lymphocyte therapy. In allogeneic cancer immunotherapy, culture expanded immune cells or stem cells originating from a single donor provide treatments to large numbers of patients. Such immune cells or stems cells can also be modified in a variety of ways in culture. In some embodiments, lymphocytes can be isolated, modified, and introduced into a different subject. This technique is known as allogenic lymphocyte therapy.

In certain embodiments, such immunotherapy methods can utilize lymphocytes including but not limited a T cell, a natural killer cell (NK cell), a B cell, a tumor infiltrating lymphocyte (TIL), a chimeric antigen receptor T cell (CAR-T cell), a T cell receptor engineered T cell (TCR), a TCR CAR-T cell, a CAR TIL cell, a CAR-NK cell, an engineered NK cell, or a hematopoietic stem cell that gives rise to a lymphocyte cell. In other embodiments, the cell is a stem cell, a dendritic cell, or the like. The genomes of such cells can be modified (e.g., generation of insertions and/or deletions in a lymphocyte cell genome) by use of one or more engineered Class I Type I Cascade effector complexes of the present invention.

Lymphocytes for modification can be isolated from a subject, such as a human subject, for example from blood or from solid tumors, such as in the case of TILs, or from lymphoid organs such as the thymus, bone marrow, lymph nodes, and mucosal-associated lymphoid tissues. Techniques for isolating lymphocytes are well known in the art. For example, lymphocytes can be isolated from peripheral blood mononuclear cells (PBMCs), which are separated from whole blood using, for example, ficoll, a hydrophilic polysaccharide that separates layers of blood, and density gradient centrifugation. Generally, anticoagulant or defibrinated blood specimens are layered on top of a ficoll solution, and centrifuged to form different layers of cells. The bottom layer includes red blood cells (erythrocytes), which are collected or aggregated by the ficoll medium and sink completely through to the bottom. The next layer contains primarily granulocytes, which also migrate down through the ficoll-paque solution. The next layer includes lymphocytes, which are typically at the interface between the plasma and the ficoll solution, along with monocytes and platelets. To isolate the lymphocytes, this layer is recovered, washed with a salt solution to remove platelets, ficoll and plasma, then centrifuged again. Alternatively, cells can be isolated from donor blood through centrifugation techniques (e.g., using a CellSaver® (Haemonetics, Braintree, MA) machine or a Lovo Automated Cell Processing System (Fresenius Kabi USA, LLC, Lake Zurich, IL)).

Other techniques for isolating lymphocytes include biopanning, which isolates cell populations from solution by binding cells of interest to antibody-coated plastic surfaces. Unwanted cells are then removed by treatment with specific antibody and complement. Additionally, fluorescence-activated cell sorting (FACS) analysis can be used to detect and count lymphocytes. FACS analysis uses a flow cytometer that separates labeled cells based on differences in light scattering and fluorescence.

For TILs, lymphocytes are isolated from a tumor and grown, for example, in high-dose IL-2 and selected using cytokine release coculture assays against either autologous tumor or HLA-matched tumor cell lines. Cultures with evidence of increased specific reactivity compared to allogeneic non-MHC matched controls are selected for rapid expansion and then introduced into a subject in order to treat cancer (see, e.g., Rosenberg, S., et al., Clin. Cancer Res. 17:4550-4557 (2011); Dudly, M., et al., Science 298:850-854 (2002); Dudly, M., et al., J. Clin. Oncol. 26:5233-5239 (2008); Dudley, M., et al., J. Immnother. 26:332-342 (2003)).

Upon isolation, lymphocytes can be characterized in terms of specificity, frequency and function. Frequently used assays include an ELISPOT assay, which measures the frequency of T cell response.

In some embodiments, CD4+ and CD8+ T cells are isolated from donor peripheral blood mononuclear cell (PBMCs). One of ordinary skill in the art can isolate T-cells, or other lymphoid cells, by a variety of methods as described above. Such cells also can be isolated by differentiation from iPSC cells.

After isolation, lymphocytes can be activated using techniques known in the art in order to promote proliferation and differentiation into specialized effector lymphocytes. Surface markers for activated T cells include, for example, CD3, CD4, CD8, PD1, IL2R, and others. Activated cytotoxic lymphocytes can kill target cells after binding cognate receptors on the surface of target cells. Surface markers for NK cells include, for example CD16, CD56, and others.

Following isolation and optionally activation, lymphocytes can be modified in order to provide desired characteristics. One or more engineered Type I Cascade effector complexes of the present invention can be used to introduce genomic modifications including, but not limited to, introduction of coding sequences to be expressed and/or inactivating endogenous gene expression. In some embodiments, one or more engineered Type I Cascade effector complexes of the present invention can be used for editing the TRAC gene (encoding T cell receptor α constant), B2M gene (encoding β2 microglobulin), and/or PDCD1 gene (encoding programmed cell death protein 1; also known as PD-1).

T cells and NK cells are examples of lymphocytes that can be modified by the methods of the present invention. In some embodiments, one or more engineered Type I Cascade effector complexes of the present invention can be used to introduce a cut site in a target region of a gene in the presence of a donor polynucleotide comprising a CAR, wherein at the CAR is incorporated into the target region of the genome of the lymphocyte. In additional embodiments, one or more engineered Type I Cascade effector complexes of the present invention can be used to introduce a cut site in a target region of a gene to facilitate generation of a knock-out mutation to prevent expression of the gene.

In another embodiment engineered Type I Cascade effector complexes of the present invention can be used to introduce genomic modifications into human iPSCs. In some embodiments, one or more engineered Type I Cascade effector complexes of the present invention can be used for editing the TRAC gene, the B2M gene, and/or the PDCD1gene. In further embodiments, engineered Type I Cascade effector complexes together with a donor polynucleotide can be used to introduce genomic modifications and coding sequences such as a CAR or a cytokine (e.g., IL2, IL15 and the like). The modified iPSC cells can then be differentiated further to mature cell types comprising T cells and NK cells or dendritic cells. In some embodiments, modified iPSCs can be differentiated to CAR-T cells and CAR-NK cells.

In some embodiments of the methods of the present invention, the donor polynucleotide comprises a polynucleotide encoding a CAR. The CAR can be targeted for insertion into a target region of a gene (e.g., the TRAC gene) comprising a cut site via homologous recombination ("knock-in"). An advantage of this approach is that it can also provide a knock-out of the targeted TRAC gene; that is, the TRAC gene is rendered inoperative. Example of extracellular antigen-recognizing domains that can be incorporated into CAR constructs are described above (see Table 2). In one embodiment, the extracellular antigen-recognizing domain comprises a CD19 binding moiety (e.g., an anti-CD19 scFv). In another embodiment, the extracellular antigen-recognizing domain comprises a B-cell maturation antigen (BCMA) binding moiety (e.g., an anti-BCMA scFv).

In embodiments of the methods of the present invention comprising generating a cut site in a target region of DNA, the method can further comprise introducing a donor polynucleotide into the modified cell thereby facilitating insertion of at least a portion of the donor polynucleotide into the target region comprising a cut site of the modified cell. The donor polynucleotide can be directly introduced into the modified cell. In some embodiments, the donor polynucleotide is introduced in using a vector. General methods for the construction of vectors are known in the art. Examples of viral vectors include, but are not limited to, lentivirus, retrovirus, adenovirus, herpes simplex virus I or II, parvovirus, reticuloendotheliosis virus, and AAV vectors.

A further embodiment of the methods of the present invention comprises introduction of a mutation in the B2M gene. In preferred embodiments, the mutation is a knock-out mutation in the B2M gene.

A further embodiment of the methods of the present invention comprises introduction of a mutation in the PDCD1 gene. In preferred embodiments, the mutation is a knock-out mutation in the PDCD1 gene.

Genomic modifications facilitated by one or more engineered Type I Cascade effector complexes of the present invention can be performed by simultaneously or serially introducing either engineered Cascade complexes, polynucleotides (e.g, plasmids or expression cassettes), or mixtures thereof into a host cell (e.g., a lymphocyte).

After producing the modified lymphocytes, the lymphocytes can be screened to select for cells either expressing (e.g., expressing the desired cell surface receptor) or not expressing (e.g., a cell surface protein whose expression has been inactivated through genome editing using one or more engineered Type I Cascade effector complexes), using methods such as high-throughput screening techniques including, but not limited to, FACS, microfluidics-based screening platforms, and the like. These techniques are known in the art (see, e.g., Wojcik, M., et al., Int. J. Mol. Sci. 16:24918-24945 (2015)).

Once produced, the modified lymphocytes can be formulated into pharmaceutical compositions for delivery to the subject to be treated. Compositions of the present invention include a modified lymphocyte and one or more pharmaceutically acceptable excipients. Exemplary excipients include, without limitation, carbohydrates, inorganic salts, antimicrobial agents, antioxidants, surfactants, buffers, acids, bases, and combinations thereof. Excipients suitable for injectable compositions include water, alcohols, polyols, glycerine, vegetable oils, phospholipids, and surfactants. A carbohydrate such as a sugar, a derivatized sugar such as an alditol, aldonic acid, an esterified sugar, and/or a sugar polymer may be present as an excipient. Specific carbohydrate excipients include, for example: monosaccharides, such as fructose, maltose, galactose, glucose, D-mannose, sorbose, and the like; disaccharides, such as lactose, sucrose, trehalose, cellobiose, and the like; polysaccharides, such as raffinose, melezitose, maltodextrins, dextrans, starches, and the like; and alditols, such as mannitol, xylitol, maltitol, lactitol, xylitol, sorbitol (glucitol), pyranosyl sorbitol, myo-inositol, and the like. The excipient can also include an inorganic salt or buffer such as citric acid, sodium chloride, potassium chloride, sodium sulfate, potassium nitrate, sodium phosphate monobasic, sodium phosphate dibasic, and combinations thereof. Freezing agents (e.g., CryoStor® (BioLife Solutions Inc, Bothell, WA) CS2, CS5, or CS10 freeze media) can be used to freeze cells for storage and transport.

A pharmaceutical composition of the invention can also include an antimicrobial agent for preventing or deterring microbial growth. Nonlimiting examples of antimicrobial agents suitable for the present invention include benzalkonium chloride, benzethonium chloride, benzyl alcohol, cetylpyridinium chloride, chlorobutanol, phenol, phenylethyl alcohol, phenylmercuric nitrate, thimerosal, and combinations thereof.

An antioxidant can also be present in the pharmaceutical composition. Antioxidants are used to prevent oxidation, thereby preventing the deterioration of the lymphocytes or other components of the preparation. Suitable antioxidants for use in the present invention include, for example, ascorbyl palmitate, butylated hydroxyanisole, butylated hydroxytoluene, hypophosphorous acid, monothioglycerol, propyl gallate, sodium bisulfite, sodium formaldehyde sulfoxylate, sodium metabisulfite, and combinations thereof.

A surfactant can be present as an excipient. Exemplary surfactants include: polysorbates, such as TWEEN 20 and TWEEN 80, and pluronics such as F68 and F88 (BASF, Mount Olive, New Jersey); sorbitan esters; lipids, such as phospholipids such as lecithin and other phosphatidylcholines, phosphatidylethanolamines (although preferably not in liposomal form), fatty acids and fatty esters; steroids, such as cholesterol; chelating agents, such as EDTA; and zinc and other such suitable cations.

Acids or bases can be present as an excipient in the pharmaceutical composition. Nonlimiting examples of acids that can be used include those acids selected from the group consisting of hydrochloric acid, acetic acid, phosphoric acid, citric acid, malic acid, lactic acid, formic acid, trichloroacetic acid, nitric acid, perchloric acid, phosphoric acid, sulfuric acid, fumaric acid, and combinations thereof. Examples of suitable bases include, without limitation, bases selected from the group consisting of sodium hydroxide, sodium acetate, ammonium hydroxide, potassium hydroxide, ammonium acetate, potassium acetate, sodium phosphate, potassium phosphate, sodium citrate, sodium formate, sodium sulfate, potassium sulfate, potassium fumerate, and combinations thereof.

The amount of lymphocytes (or other recombinant cells) in the composition will vary depending on a number of factors, but will optimally be a therapeutically effective dose when the composition is in a unit dosage form or container (e.g., a bag). A therapeutically effective dose can be determined experimentally by repeated administration of increasing amounts of the composition in order to determine which amount produces a clinically desired endpoint.

The amount of any individual excipient in the composition will vary depending on the nature and function of the excipient and particular needs of the composition. Typically, the optimal amount of any individual excipient is determined through routine experimentation, i.e., by preparing compositions containing varying amounts of the excipient (ranging from low to high), examining the stability and other parameters, and then determining the range at which optimal performance is attained with no significant adverse effects. Generally, however, the excipient(s) will be present in the composition in an amount of about 1% to about 99% by weight, preferably from about 5% to about 98% by weight, more preferably from about 15% to about 95% by weight of the excipient, with concentrations less than 30% by weight most preferred. These foregoing pharmaceutical excipients along with other excipients are described in "Remington: The Science & Practice of Pharmacy," current edition, Williams & Williams; the "Physician's Desk Reference," current edition, Medical Economics, Montvale, NJ; and Kibbe, A. H., Handbook of Pharmaceutical Excipients, current edition, American Pharmaceutical Association, Washington, D.C.

The pharmaceutical compositions can be housed in a syringe, an implantation device, or the like, depending upon the intended mode of delivery and use. Preferably, the amount of the composition present is appropriate for a single dose, in a premeasured or pre-packaged form.

The pharmaceutical compositions herein may optionally include one or more additional agents, such as other medications used to treat a subject for the cancer in question or to treat known side-effects from the treatment. For example, T cells release cytokines into the bloodstream, which can lead to dangerously high fevers and precipitous drops in blood pressure. This condition is known as cytokine release syndrome (CRS). In many patients, CRS can be managed with standard supportive therapies, including steroids and immunotherapies, such as tocilizumab (Actemra™, Genentech, South San Francisco, CA) that block IL-6 activity.

At least one therapeutically effective cycle of treatment with a modified lymphocyte composition will be administered to a subject. By "therapeutically effective cycle of treatment" is intended a cycle of treatment that, when administered, brings a positive therapeutic response with respect to treatment of an individual for the disease in question. By "positive therapeutic response" is intended that the individual undergoing treatment according to the invention exhibits an improvement in one or more symptoms of the disease, including such improvements as tumor reduction and/or reduced need for lymphocyte therapy.

In certain embodiments, multiple therapeutically effective doses of compositions comprising the lymphocytes or other medications will be administered. The compositions of the present invention are typically, although not necessarily, administered via injection, such as subcutaneously, intradermally, intravenously, intraarterially, intramuscularly, intraperitoneally, intramedullary, intratumorally, intranodally), by infusion, or locally. The pharmaceutical preparation can be in the form of a liquid solution or suspension immediately prior to administration. The foregoing is meant to be exemplary as additional modes of administration are also contemplated. The pharmaceutical compositions may be administered using the same or different routes of administration in accordance with any medically acceptable method known in the art.

The actual dose to be administered will vary depending upon the age, weight, and general condition of the subject as well as the severity of the condition being treated, the judgment of the health care professional, and particular lymphocytes being administered. Therapeutically effective amounts can be determined by those skilled in the art, and will be adjusted to the particular requirements of each particular case.

Generally, a therapeutically effective amount of lymphocytes will range from a total of about $1\times10^5$ to about $1\times10^{10}$ lymphocytes or more per patient, such as $1\times10^6$ to about $1\times10^{10}$, e.g., $1\times10^7$ to $1\times10^9$, such as $5\times10^7$ to $5\times10^8$, or any amount within these ranges. Other dosage ranges can be $1\times10^4$ to $1\times10^{10}$ cells per kg/bodyweight. The total number of lymphocytes can be administered in a single bolus dose, or can be administered in two or more doses, such as one or more days apart. The total number of lymphocytes can be administered in a single bolus dose, or can be administered in two or more doses, such as one or more days apart. The amount of compound administered will depend on the potency of the specific lymphocyte composition, the disease being treated and the route of administration.

Additionally, the doses can comprise a mixture of lymphocytes, such as a mix of CD8+ and CD4+ cells. If a mix of CD8+ and CD4+ cells is provided, the ratio of CD8+ to CD4+ cells can be for example, 1:1, 1:2 or 2:1, 1:3 or 3:1, 1:4 or 4:1, 1:5 or 5:1, etc.

Modified lymphocytes can be administered prior to, concurrent with, or subsequent to other agents. If provided at the same time as other agents, the modified lymphocytes can be provided in the same or in a different composition. Thus, the lymphocytes and other agents can be presented to the individual by way of concurrent therapy. By "concurrent therapy" is intended administration to a subject such that the therapeutic effect of the combination of the substances is caused in the subject undergoing therapy. For example, concurrent therapy may be achieved by administering a dose of a pharmaceutical composition comprising modified lymphocytes and a dose of a pharmaceutical composition comprising at least one other agent, such as another chemotherapeutic agent, which in combination comprises a therapeutically effective dose, according to a particular dosing regimen. Similarly, modified lymphocytes and therapeutic agents can be administered in at least one therapeutic dose. Administration of the separate pharmaceutical compositions can be performed simultaneously or at different times (e.g., sequentially, in either order, on the same day, or on different days), as long as the therapeutic effect of the combination of these substances is caused in the subject undergoing therapy.

As described herein, the engineered Type I Cascade effector complexes of the present invention provide genome editing tools. Experiments demonstrating the functional reconstitution of Class 1 CRISPR-Cas system in mammalian cells for genome editing show that such streamlined plasmid designs can allow use of other Class 1 CRISPR-Cas systems, including those that exhibit fewer protein components and unique PAM requirements, and potentially even RNA- and DNA-targeting effector complexes from Type III CRISPR-Cas systems (see, e.g., Hille, F., et al., Cell 172:1239-1259 (2018); Tamulaitis, G., et al., Trends Microbiol. 25:49-61 (2017)). The multi-subunit nature of Cascade complexes provides the potential for multivalent and/or sterically precise recruitment of effector fusions such as synthetic transcription factors, epigenome modifiers, and base editors. In addition, heterologous expression of the complete DNA interference pathway from Type I systems—namely, Cascade-mediated recruitment of the Cas3 helicase-nuclease to genomic target sites—can be exploited to generate large DNA deletions, to expose long ssDNA tracts for homology-directed repair, and/or to mechanically disrupt protein-DNA roadblocks at defined genomic loci. Accordingly, in one embodiment of the present invention, engineered Class 1 CRISPR-Cas systems can be used to generate large deletion regions and a donor polynucleotide (e.g., comprising suitable homology arms) can be introduced into the cell, thus facilitating insertion of at least a portion of the donor polynucleotide into the region.

Embodiments of the present invention include, but are not limited to, the following.

Embodiment 1. A composition comprising:
  a first engineered Class 1 Type I CRISPR-Cas effector complex comprising,
    a first Cse2 subunit protein, a first Cas5 subunit protein, a first Cas6 subunit protein, and a first Cas7 subunit protein,
    a first fusion protein comprising a first Cas8 subunit protein and a first FokI, wherein the N-terminus of the first Cas8 subunit protein or the C-terminus of the first Cas8 subunit protein is covalently connected by a first linker polypeptide to the C-terminus or N-terminus, respectively, of the first FokI, and wherein the first linker polypeptide has a length of between about 10 amino acids and about 40 amino acids, and
    a first guide polynucleotide comprising a first spacer capable of binding a first nucleic acid target sequence; and
  a second engineered Class 1 Type I CRISPR-Cas effector complex comprising,
    a second Cse2 subunit protein, a second Cas5 subunit protein, a second Cas6 subunit protein, and a second Cas7 subunit protein,
    a second fusion protein comprising a second Cas8 subunit protein and a second FokI, wherein the N-terminus of the second Cas8 subunit protein or the C-terminus of the second Cas8 subunit protein is covalently connected by a second linker polypeptide to the C-terminus or N-terminus, respectively, of the second FokI, and wherein the second linker polypeptide has a length of between about 10 amino acids and about 40 amino acids, and a second guide polynucleotide comprising a second spacer capable of binding a second nucleic acid target sequence, wherein a protospacer adjacent motif (PAM) of the second nucleic acid target sequence and a PAM of the first nucleic acid target sequence have an interspacer distance between about 20 bp and about 42 bp.

Embodiment 2. The composition of embodiment 1, wherein the first linker polypeptide has a length of between about 15 amino acids and about 30 amino acids.

Embodiment 3. The composition of embodiment 2, wherein the first linker polypeptide has a length of between about 17 amino acids and about 20 amino acids.

Embodiment 4. The composition of any one of embodiments 1-3, wherein the second linker polypeptide has a length of between about 15 amino acids and about 30 amino acids.

Embodiment 5. The composition of embodiment 4, wherein the second linker polypeptide has a length of between about 17 amino acids and about 20 amino acids.

Embodiment 6. The composition of any preceding embodiment, wherein the length of the first linker polypeptide and the second linker polypeptide are the same.

Embodiment 7. The composition of any preceding embodiment, wherein the second nucleic acid target sequence and the first nucleic acid target sequence each has an interspacer distance between about 22 bp and about 40 bp.

Embodiment 8. The composition of embodiment 7, wherein the second nucleic acid target sequence and the first nucleic acid target sequence each has an interspacer distance between about 26 bp and about 36 bp.

Embodiment 9. The composition of embodiment 8, wherein the second nucleic acid target sequence and the first nucleic acid target sequence each has an interspacer distance between about 29 bp and about 35 bp.

Embodiment 10. The composition of embodiment 9, wherein the second nucleic acid target sequence and the first nucleic acid target sequence each has an interspacer distance between about 30 bp and about 34 base bp.

Embodiment 11. The composition of any preceding embodiment, wherein the first FokI and the second FokI are monomeric subunits capable of associating to form a homodimer.

Embodiment 12. The composition of any one of embodiments 1-10, wherein the first FokI and the second FokI are distinct monomeric subunits capable of associating to form a heterodimer.

Embodiment 13. The composition of any preceding embodiment, wherein the N-terminus of the first Cas8 subunit protein is covalently connected by the first linker polypeptide to the C-terminus of the first FokI.

Embodiment 14. The composition of any one of embodiments 1-12, wherein the C-terminus of the first Cas8 subunit protein is covalently connected by a first linker polypeptide to the N-terminus of the first FokI.

Embodiment 15. The composition of any preceding embodiment, wherein the N-terminus of the second Cas8 subunit protein is covalently connected by the second linker polypeptide to the C-terminus of the second FokI.

Embodiment 16. The composition of any one of embodiments 1-14, wherein the C-terminus of the second Cas8 subunit protein is covalently connected by a second linker polypeptide to the N-terminus of the second FokI.

Embodiment 17. The composition of any preceding embodiment, wherein the first Cas8 subunit protein and the second Cas8 subunit protein each comprises identical amino acid sequences.

Embodiment 18. The composition of any preceding embodiment, wherein the first Cse2 subunit protein and the second Cse2 subunit protein each comprises identical amino acid sequences, the first Cas5 subunit protein and the second Cas5 subunit protein each comprises identical amino acid sequences, the first Cas6 subunit protein and the second Cas6 subunit protein each comprises identical amino acid sequences, and the first Cas7 subunit protein and the second Cas7 subunit protein each comprises identical amino acid sequences.

Embodiment 19. The composition of any preceding embodiment, wherein the first guide polynucleotide comprises RNA.

Embodiment 20. The composition of any preceding embodiment, wherein the second guide polynucleotide comprises RNA.

Embodiment 21. The composition of any preceding embodiment, wherein genomic DNA comprises the PAM of the second nucleic acid target sequence and the PAM of the first nucleic acid target sequence.

Embodiment 22. A cell comprising: the composition of any preceding embodiment.

Embodiment 23. The cell of embodiment 22, wherein genomic DNA of the cell comprises the PAM of the second nucleic acid target sequence and the PAM of the first nucleic acid target sequence.

Embodiment 24. The cell of embodiment 22 or 23, wherein the cell is a prokaryotic cell.

Embodiment 25. The cell of embodiment 22 or 23, wherein the cell is a eukaryotic cell.

Embodiment 26. One or more nucleic acid sequences encoding the first Cse2 subunit protein, the first Cas5 subunit protein, the first Cas6 subunit protein, the first Cas7 subunit protein, the first fusion protein, and the first guide polynucleotide of any one of embodiments 1-21.

Embodiment 27. One or more nucleic acid sequences encoding the second Cse2 subunit protein, the second Cas5 subunit protein, the second Cas6 subunit protein, the second Cas7 subunit protein, the second fusion protein, and the second guide polynucleotide of any one of embodiments 1-21.

Embodiment 28. One or more expression cassettes comprising the one or more nucleic acid sequences of embodiment 26, embodiment 27, or embodiment 26 and embodiment 27.

Embodiment 29. One or more vectors comprising the one or more expression cassettes of embodiment 28.

Embodiment 30. A method of binding a polynucleotide comprising the first nucleic acid target sequence and the second nucleic acid target sequence, the method comprising:

providing the composition of any one of embodiments 1-21 for introduction into a cell or a biochemical reaction; and introducing the composition into the cell or the biochemical reaction, thereby facilitating contact of the first engineered Class 1 Type I CRISPR-Cas effector complex with the first nucleic acid target sequence and contact of the second engineered Class 1 Type I CRISPR-Cas effector complex with the second nucleic acid target sequence, resulting in binding of the first engineered Class 1 Type I CRISPR-Cas effector complex with the first nucleic acid target sequence and binding of the second engineered Class 1 Type I CRISPR-Cas effector complex with the second nucleic acid target sequence in the polynucleotide.

Embodiment 31. The method of embodiment 30, wherein genomic DNA comprises the polynucleotide.

Embodiment 32. A method of cutting a polynucleotide comprising the first nucleic acid target sequence and the second nucleic acid target sequence, the method comprising:
providing the composition of any one of embodiments 1-21 for introduction into a cell or a biochemical reaction; and
introducing the composition into the cell or the biochemical reaction, thereby facilitating contact of the first engineered Class 1 Type I CRISPR-Cas effector complex with the first nucleic acid target sequence and contact of the engineered second Class 1 Type I CRISPR-Cas effector complex with the second nucleic acid target sequence, resulting in cutting of the first nucleic acid target sequence by the first engineered Class 1 Type I CRISPR-Cas effector complex and cutting of the second nucleic acid target sequence by the second engineered Class 1 Type I CRISPR-Cas effector complex.

Embodiment 33. The method of embodiment 32, wherein genomic DNA comprises the polynucleotide.

Embodiment 34. A kit comprising: the composition of any one of embodiments 1-21; and a buffer.

Embodiment 35. A kit comprising: the one or more nucleic acid sequences of embodiment 26, embodiment 27, or embodiment 26 and embodiment 27; and a buffer.

Embodiment 36. A composition comprising:
an engineered Class 1 Type I CRISPR-Cas effector complex comprising,
 a Cse2 subunit protein, a Cas5 subunit protein, a Cas6 subunit protein, and a Cas7 subunit protein,
 a first fusion protein comprising a Cas8 subunit protein and a first FokI, wherein the N-terminus of the first Cas8 subunit protein or the C-terminus of the first Cas8 subunit protein is covalently connected by a first linker polypeptide to the C-terminus or N-terminus, respectively, of the first FokI, and
 a guide polynucleotide comprising a spacer capable of binding a nucleic acid target sequence; and
a second fusion protein comprising an engineered Class 1 Type I CRISPR-Cas3 fusion protein comprising a dCas3* protein and a second FokI, wherein the N-terminus of the dCas3* protein or the C-terminus of the dCas3* protein is covalently connected by a second linker polypeptide to the C-terminus or N-terminus, respectively, of the second FokI, and wherein the first linker polypeptide has a length of between about 10 amino acids and about 40 amino acids, effector complex comprising, Embodiment 37. The composition of embodiment 36, wherein the first linker polypeptide has a length of between about 5 amino acids and about 40 amino acids.

Embodiment 38. The composition of embodiment 36, wherein the second linker polypeptide has a length of between about 5 amino acids and about 40 amino acids.

Embodiment 39. A cell comprising: the composition of any one of embodiments 36 to 38.

Embodiment 40. The cell of embodiment 39, wherein the cell is a prokaryotic cell.

Embodiment 41. The cell of embodiment 39, wherein the cell is a eukaryotic cell.

Embodiment 42. One or more nucleic acid sequences encoding the Cse2 subunit protein, the Cas5 subunit protein, the Cas6 subunit protein, the Cas7 subunit protein, the first fusion protein, and the guide polynucleotide of any one of embodiments 36 to 38.

Embodiment 43. One or more nucleic acid sequences encoding the second fusion protein of any one of embodiments 36 to 38.

Embodiment 44. One or more expression cassettes comprising the one or more nucleic acid sequences of embodiment 42, embodiment 43, or embodiment 42 and embodiment 43.

Embodiment 45. One or more vectors comprising the one or more expression cassettes of embodiment 44.

Embodiment 46. A method of binding a polynucleotide comprising the nucleic acid target sequence, the method comprising:
providing the composition of any one of embodiments 36 to 38 for introduction into a cell or a biochemical reaction; and
introducing the composition into the cell or the biochemical reaction, thereby facilitating contact of the engineered Class 1 Type I CRISPR-Cas effector complex with the nucleic acid target sequence and contact of the second fusion protein with the engineered Class 1 Type I CRISPR-Cas effector complex, resulting in binding of the engineered Class 1 Type I CRISPR-Cas effector complex and the second fusion protein to the nucleic acid target sequence in the polynucleotide.

Embodiment 47. The method of embodiment 46, wherein genomic DNA comprises the polynucleotide.

Embodiment 48. A method of cutting a polynucleotide comprising the nucleic acid target sequence, the method comprising:
providing the composition of any one of embodiments 36 to 38 for introduction into a cell or a biochemical reaction; and
introducing the composition into the cell or the biochemical reaction, thereby facilitating contact of the first engineered Class 1 Type I CRISPR-Cas effector complex with the first nucleic acid target sequence and contact of the engineered second Class 1 Type I CRISPR-Cas effector complex with the second nucleic acid target sequence,
introducing the composition into the cell or the biochemical reaction, thereby facilitating contact of the engineered Class 1 Type I CRISPR-Cas effector complex with the nucleic acid target sequence and contact of the second fusion protein with the engineered Class 1 Type I CRISPR-Cas effector complex, resulting in cutting of the nucleic acid target sequence by the engineered Class 1 Type I CRISPR-Cas effector complex and the second fusion protein.

Embodiment 49. The method of embodiment 48, wherein genomic DNA comprises the polynucleotide.

Embodiment 50. A kit comprising: the composition of any one of embodiments 36 to 38; and a buffer.

Embodiment 51. A kit comprising: the one or more nucleic acid sequences of embodiment 42, embodiment 43, or embodiment 42 and embodiment 43; and a buffer.

Embodiment 52. An engineered Type I CRISPR Cas3 mutant protein ("mCas3 protein") capable of reduced movement along DNA relative to a wild-type Type I CRISPR Cas3 protein ("wtCas3 protein"), the mCas3 protein comprising:
about 95% or higher sequence identity to the corresponding wtCas3 protein, a nuclear localization signal is covalently connected at the amino terminus, carboxy terminus, or both the amino and carboxy termini, and one or more mutations that down-modulates helicase activity, wherein the engineered Type I CRISPR Cas3 mutant protein retains nuclease activity;

wherein the DNA is double-stranded DNA (dsDNA) comprising a target region comprising a nucleic acid target sequence;

wherein when the wtCas3 protein is associated with a corresponding Cascade nucleoprotein complex ("Cascade NP complex/wtCas3 protein"), and the Cascade NP complex comprises a guide comprising a spacer complementary to the nucleic acid target sequence, binding of the Cascade NP complex/wtCas3 protein to the nucleic acid target sequence facilitates cleavage in the target region of the DNA, thereby resulting in a deletion ("wtCas3-deletion"); and wherein the mCas3 protein when it is associated with the Cascade NP complex ("Cascade NP complex/mCas3 protein) and binds the nucleic acid target sequence facilitates cleavage in the target region of the DNA, thereby resulting in a shorter deletion relative to the wtCas3-deletion.

Embodiment 53. The mCas3 protein of embodiment 53, wherein the one or more mutations are substitutions of amino acids.

Embodiment 54. The mCas3 protein any preceding embodiment, wherein the one or more mutations are in either the RecA1 region or RecA2 region of the helicase domain.

Embodiment 55. The mCas3 protein of any preceding embodiment, wherein the one or more mutations down-modulate binding of the mCas3 protein to single-stranded DNA (ssDNA) relative to the wtCas3 protein.

Embodiment 56. The mCas3 protein of any preceding embodiment, wherein the one or more mutations down-modulate hydrolysis of adenosine triphosphate (ATP) by the mCas3 protein or down-modulate binding of ATP to the mCas3 protein relative to the wtCas3 protein.

Embodiment 57. The mCas3 protein of any preceding embodiment, wherein coding sequences for the mCas3 protein are covalently connected to the amino terminus or carboxy terminus of coding sequences of a Cas protein of the Cascade NP complex.

Embodiment 58. The mCas3 protein of any preceding embodiment, wherein the one or more mutations down-modulate binding of the mCas3 protein to single-stranded DNA (ssDNA) relative to the wtCas3 protein.

Embodiment 59. The mCas3 protein of any preceding embodiment, wherein coding sequences for the mCas3 protein are covalently connected to the amino terminus or carboxy terminus of coding sequences of a Cas protein of the Cascade RNP complex.

Embodiment 60. The mCas3 protein of any preceding embodiment wherein the Cas protein is selected from the group consisting of Cse2, Cas8 protein, Cas7 protein, Cas6 protein, and Cas5 protein.

Embodiment 61. The mCas3 protein of any preceding embodiment, wherein the wtCas3 protein is an *E. coli* Type 1 CRISPR Cas3 protein.

Embodiment 62. The mCas3 protein of embodiment 61, wherein the one or more mutations are selected from the group consisting of D452H, A602V, and D452H and A602V.

Embodiment 63. The mCas3 protein of any preceding embodiment, wherein the DNA is within a cell.

Embodiment 64. The mCas3 protein of embodiment 63, wherein the cell is a eukaryotic cell.

Embodiment 65. The mCas3 protein of embodiment 64, wherein the eukaryotic cell is a mammalian cell (e.g., human cell).

Embodiment 66. One or more polynucleotide encoding the mCas3 protein of any one of embodiments 52 to 65.

Embodiment 67. A plasmid comprising a polynucleotide sequence encoding the mCas3 protein of any one of embodiments 52 to 65 operably linked to regulatory sequences for expression in a mammalian cell.

Embodiment 68. One or more plasmid comprising a polynucleotide sequence encoding the mCas3 protein of any one of embodiments 52 to 65, and one or more polynucleotides encoding protein components of a corresponding Type I CRISPR Cascade operably linked to regulatory sequences for expression in a mammalian cell.

Embodiment 69. The one or more plasmids of embodiment 68, further comprising a plasmid encoding one or more guide polynucleotide operably linked to regulatory sequences for expression in a mammalian cell.

Embodiment 70. A Type I CRISPR Cascade nucleoprotein complex comprising the mCas3 protein of any one of embodiments 52 to 65.

Embodiment 71. The Type I CRISPR Cascade nucleoprotein complex of embodiment 70, wherein the nucleoprotein complex is an RNP.

Although preferred embodiments of the present invention have been shown and described herein, it will be obvious to those skilled in the art that such embodiments are provided by way of example only. From the present Specification and the Examples, one skilled in the art can ascertain essential characteristics of this invention, and without departing from the spirit and scope thereof, can make changes, substitutions, variations, and modifications of the invention to adapt it to various usages and conditions. Such changes, substitutions, variations, and modifications are also intended to fall within the scope of the present disclosure.

EXPERIMENTAL

Aspects of the present invention are illustrated in the following Examples. Efforts have been made to ensure accuracy with respect to numbers used (e.g., amounts, concentrations, percent changes, and the like) but some experimental errors and deviations should be accounted for. Unless indicated otherwise, temperature is in degrees Centigrade and pressure is at or near atmospheric. It should be understood that these Examples are given by way of illustration only and are not intended to limit the scope of the present invention.

Example 1

In Silico Design of Polynucleotides Encoding Cascade Components

This Example provides a description of the design of polynucleotide components encoding Cascade using gene, protein, and CRISPR sequences derived from a Type I-E CRISPR-Cas system.

Table 15 presents polynucleotide DNA sequences of genes encoding the five proteins of Cascade from Type I-E, specifically from *E. coli* strain K-12 MG1655, as well as the amino acid sequences of the resulting protein components. Genomic sequences were obtained from NCBI Reference Sequence NZ_CP014225.1. In Table 15, polynucleotide sequences were either amplified from *E. coli* gDNA or manufacturer-produced polynucleotides encoding Cascade protein components that were codon-optimized specifically for expression in *E. coli* and also for expression in human cells.

TABLE 15

Cas Protein DNA and Amino Acid Sequences

| Protein | Type of sequence | DNA coding sequence | Amino acid sequence |
|---|---|---|---|
| Cas8 | genomic | SEQ ID NO: 1 | SEQ ID NO: 16 |
| Cse2 | genomic | SEQ ID NO: 2 | SEQ ID NO: 17 |
| Cas7 | genomic | SEQ ID NO: 3 | SEQ ID NO: 18 |
| Cas5 | genomic | SEQ ID NO: 4 | SEQ ID NO: 19 |
| Cas6 | genomic | SEQ ID NO: 5 | SEQ ID NO: 20 |
| Cas8 | *E. coli* codon-optimized | SEQ ID NO: 6 | SEQ ID NO: 16 |
| Cse2 | *E. coli* codon-optimized | SEQ ID NO: 7 | SEQ ID NO: 17 |
| Cas7 | *E. coli* codon-optimized | SEQ ID NO: 8 | SEQ ID NO: 18 |
| Cas5 | *E. coli* codon-optimized | SEQ ID NO: 9 | SEQ ID NO: 19 |
| Cas6 | *E. coli* codon-optimized | SEQ ID NO: 10 | SEQ ID NO: 20 |
| Cas8 | *H. sapiens* codon-optimized | SEQ ID NO: 11 | SEQ ID NO: 16 |
| Cse2 | *H. sapiens* codon-optimized | SEQ ID NO: 12 | SEQ ID NO: 17 |
| Cas7 | *H. sapiens* codon-optimized | SEQ ID NO: 13 | SEQ ID NO: 18 |
| Cas5 | *H. sapiens* codon-optimized | SEQ ID NO: 14 | SEQ ID NO: 19 |
| Cas6 | *H. sapiens* codon-optimized | SEQ ID NO: 15 | SEQ ID NO: 20 |

In addition, several fusion proteins comprising Cascade proteins were designed. Table 16 presents polynucleotide DNA sequences of genes encoding Cascade protein fusion proteins, as well as the amino acid sequences of the resulting protein components. In most instances, fusion proteins described in Table 16 include short tri-amino acid linkers connecting the two polypeptide sequences within the fusion construct; this linker typically comprises glycine-glycine-serine (GGS) or glycine-serine-glycine (GSG). The exact tri-amino acid linker sequences used in each particular fusion protein can be found in the full-length amino acid sequence in Table 16.

TABLE 16

Cascade Fusion Protein Sequences

| Cascade protein | Heterologous polypeptide | Heterologous polypeptide fused to the N- or C-terminus of the Cascade protein | DNA coding sequence | Expression system for DNA coding sequence | Amino acid sequence |
|---|---|---|---|---|---|
| Cse2 | Strep-tag ® II-HRV3C | N | SEQ ID NO: 390 | *E. coli* | SEQ ID NO: 391 |
| Cse2 | His6-HRV3C | N | SEQ ID NO: 392 | *E. coli* | SEQ ID NO: 393 |
| Cse2 | NLS | N | SEQ ID NO: 394 | Mammalian | SEQ ID NO: 395 |
| Cas5 | NLS | N | SEQ ID NO: 396 | Mammalian | SEQ ID NO: 397 |
| Cas6 | NLS | N | SEQ ID NO: 398 | *E. coli* | SEQ ID NO: 399 |
| Cas6 | NLS-HA | N | SEQ ID NO: 400 | *E. coli* | SEQ ID NO: 401 |
| Cas6 | NLS | N | SEQ ID NO: 402 | Mammalian | SEQ ID NO: 403 |
| Cas7 | NLS | C | SEQ ID NO: 404 | *E. coli* | SEQ ID NO: 405 |
| Cas7 | HA-NLS | C | SEQ ID NO: 406 | *E. coli* | SEQ ID NO: 407 |
| Cas7 | NLS | N | SEQ ID NO: 408 | Mammalian | SEQ ID NO: 409 |
| Cas8 | His6-MBP-TEV | N | SEQ ID NO: 410 | *E. coli* | SEQ ID NO: 411 |
| Cas8 | His6-MBP-TEV-NLS-FokI-linker | N | SEQ ID NO: 412 | *E. coli* | SEQ ID NO: 413 |
| Cas8 | NLS | N | SEQ ID NO: 414 | Mammalian | SEQ ID NO: 415 |
| Cas8 | NLS-HA-FokI-linker | N | SEQ ID NO: 416 | Mammalian | SEQ ID NO: 417 |

The His6 (hexahistidine; SEQ ID NO:418) and Strep-tag™ II (GE Healthcare Bio-Sciences, Pittsburgh, PA) (SEQ ID NO:419) peptide tags on the Cse2 protein, when co-expressed with other Cascade proteins, enable purification of the complex via either Nickel-nitriloacetic acid (Ni-NTA) resin or Strep-Tactin™ (IBA GMBH LLC, Göttingen, Germany) resin, respectively. The HRV3C (human rhinovirus 3C) protease recognition sequence (SEQ ID NO:420) is cleaved by an HRV3C protease and can be used to remove N-terminal fusions from a protein of interest. The NLS (nuclear localization signal; SEQ ID NO:421 peptide tag on the Cas6, Cas7, and/or Cas8 proteins enables nuclear trafficking in eukaryotic systems. The HA (hemagglutinin; SEQ ID NO:422) peptide tag on the Cas6 or Cas7 proteins enables detection of heterologous protein expression by Western blotting with an anti-HA antibody. The MBP (maltose binding protein; SEQ ID NO:423) peptide fusion is a solubilization tag that facilitates purification of the Cas8 protein. The TEV (tobacco etch virus) protease recognition sequence (SEQ ID NO:424) is cleaved by TEV protease and can be used to remove N-terminal fusions from a protein of interest. The FokI nuclease domain comprises the Sharkey variant described by Guo, et al. (Guo, J., et al., J. Mol. Biol. 400:96-107 (2010)), two monomeric FokI subunits associate to form a homodimer, and catalyze double-stranded DNA cleavage upon homo-dimerization. A linker sequence (SEQ ID NO:425) is used to fuse the FokI nuclease domain to the Cas8 protein.

Additional linker sequences of varying length and amino acid composition have been designed that connect the FokI nuclease domain to the Cas8 protein. These amino acid sequences can be found in Table 17.

TABLE 17

Amino Acid Linker Sequences

| SEQ ID NO: | Linker length (amino acids) | Amino acid sequence |
|---|---|---|
| SEQ ID NO: 426 | 5 | GGGGS |
| SEQ ID NO: 427 | 8 | TGPGAAAR |
| SEQ ID NO: 428 | 10 | GGSGSSGGSG |
| SEQ ID NO: 429 | 12 | TGPGAAARAASG |
| SEQ ID NO: 430 | 15 | GGSGSSGGSGSSGGS |
| SEQ ID NO: 431 | 16 | SGSETPGTSESATPES |
| SEQ ID NO: 432 | 20 | SGSETPGTSESATPESGGSG |
| SEQ ID NO: 433 | 30 | SGSETPGTSESATPESGGSGSSGGSGSSGG |

Table 18 contains the polynucleotide DNA sequence of four minimal CRISPR arrays that, when transcribed into precursor crRNA and processed by the RNA endonuclease protein of Cascade, generate mature crRNAs that function as the guide RNA to target complementary DNA sequences in biochemical assays and in cell culture gene editing experiments.

The minimal CRISPR array comprises two repeat sequences (underlined, lower case) flanking a spacer sequence, which represents the guide portion of the crRNA. RNA processing by the Cascade endonuclease protein generates a crRNA with repeat sequences on both the 5' and 3' ends, flanking the guide sequence. The CRISPR array may also be expanded to include three repeat sequences (underlined) flanking two spacer sequences, which represent the guide portions of two distinct crRNAs by RNA processing by the endonuclease Cascade protein. The arrays can be further expanded to include additional spacer sequences, if desired.

TABLE 18

CRISPR Array Sequences

| SEQ ID NO: | Cell type | Target | Minimal CRISPR array sequence |
|---|---|---|---|
| SEQ ID NO: 434 | E. coli | Bacteriophage λ J3 target | gagttccccgcgccagcggggataaaccgCCAGTGATAAGTGGAATGCCATGTGGGCTGTCgagttcccgcgccagcggggataaaccg |
| SEQ ID NO: 435 | E. coli | Bacteriophage λ L3 target | gagttccccgcgccagcggggataaaccgAGTGGCAGATATAGCCTGGTGGTTCAGGCGGCgagttcccgcgccagcggggataaaccg |
| SEQ ID NO: 436 | E. coli | Bacteriophage λ L3/J3 targets | gagttccccgcgccagcggggataaaccgCCAGTGATAAGTGGAATGCCATGTGGGCTGTCgagttcccgcgccagcggggataaaccgAGTGGCAGATATAGCCTGGTGGTTCAGGCGGCgagttccccgcgccagcggggataaaccg |
| SEQ ID NO: 437 | H. sapiens cell | TRAC gene | gagttccccgcgccagcggggataaaccgGTTGATTTGCCTGCATTGGTGTTACACAGTCTgagttcccgcgccagcggggataaaccgTAAGTTGTGTTCTTCTTTGCCTAGGCCTTCAGgagttccccgcgccagcggggataaaccg |

Example 2

Design of Bacterial Expression Vectors for Production of Cascade Effector Complexes This Example describes the design of bacterial expression vectors that encode the Cascade-associated proteins, as well as a minimal CRISPR array comprising the guide sequence as described in Example 1. The construction of Cascade subunit protein expression systems for use with plasmids encoding minimal CRISPR arrays is described.

A single-plasmid Cascade protein expression system was constructed to express the proteins of either a complex of Cascade in *E. coli*, known as the CasBCDE complex (which contains the Cse2, Cas7, Cas5, and Cas6 proteins, but not the Cas8 protein), or the entire functional Cascade complex in *E. coli*. The single plasmid system comprises either the cse2-cas7-cas5-cas6 operon, or the entire cas8-cse2-cas7-cas5-cas6 operon on a single expression plasmid. The Cas8 protein can be expressed from its own expression plasmid, for use in biochemical experiments where it is mixed together with the CasBCDE complex to reconstitute Cascade.

A starting plasmid for expression vector construction was used (see Brouns, S., et al., Science 321:960-964 (2008)). The single-plasmid Cascade protein expression system comprising a Cas operon was assembled as follows. The coding sequences for the cas genes were arranged in the order cse2-cas7-cas5-cas6 (CasBCDE complex or cas8-cse2-cas7-cas5-cas6 (full Cascade complex), and were separated by sequences corresponding to the wild-type bacterial gene arrangement (see NCBI Reference Sequence NZ_CP014225.1).

In order to append a polynucleotide sequence encoding an affinity tag (His6 or Strep-tag® II, IBA GMBH LLC, Göttingen, Germany), the corresponding coding sequence was inserted at the junction of the 3' end of the cas8 gene and the 5' end of the cse2 gene; these two open reading frames overlap in the wild-type gDNA sequence.

In order to append polynucleotide sequences encoding N-terminal NLS and/or NLS-HA tags onto the 5' end of the cas6 gene, additional spacing was introduced between the cas6 and upstream cas5 genes, because these open reading frames overlap in the wild-type gDNA sequence, such that the Shine-Dalgarno sequence for the cas6 gene is within the 3' portion of the cas5 gene. A new Shine-Dalgarno sequence was inserted upstream of the new NLS-Cas6 or NLS-HA-Cas6 open reading frames, to improve translational efficiency.

In order to append polynucleotide sequences encoding C-terminal NLS and/or HA-NLS tags onto the 3' end of the cas7 gene, additional spacing was introduced between the cas7 and downstream cas5 genes, because these open reading frames are in close proximity in the wild-type gDNA sequence, such that the Shine-Dalgarno sequence for the cas5 gene is within the 3' portion of the cas7 gene. A new Shine-Dalgarno sequence was inserted downstream of the new Cas7-NLS or Cas7-HA-NLS open reading frames, to improve translational efficiency for the cas5 gene.

In order to append polynucleotide sequences encoding N-terminal NLS-FokI-linker fusions to the Cas8 protein, the corresponding coding sequences were inserted at the 5' end of the cas8 gene.

The cse2-cas7-cas5-cas6 and cas8-cse2-cas7-cas5-cas6 operons were cloned into the pCDF (MilliporeSigma, Hayward, CA) vector backbone, which confers spectinomycin resistance due to the presence of the aadA gene. Transcription of the operon is driven by a T7 promoter and is under control of the Lac operator; the vector also encodes the LacI repressor. A T7 terminator was cloned downstream of the cse2-cas7-cas5-cas6 or cas8-cse2-cas7-cas5-cas6 operon. The vector contains a CDF origin of replication.

For expression of Cas8 or FokI-Cas8 fusion proteins, the cas8 gene was cloned into a pET (MilliporeSigma, Hayward, CA) family vector backbone, which confers kanamycin resistance due to the presence of the kanR gene. Transcription of the operon is driven by a T7 promoter ($P_{T7}$), and is under control of the Lac operator (lacO); the vector also encodes the LacI repressor (lacI gene). A T7 terminator was cloned downstream of the cas8 gene. The vector contains a ColE1 origin of replication.

FIG. 23A, FIG. 23B, FIG. 23C, FIG. 23D, and FIG. 23E present schematic diagrams of overexpression vectors for the cas8, fokI-cas8, the cse2-cas7-cas5-cas6 operon, the cas8-cse2-cas7-cas5-cas6 operon, and the fokI-cas8-cse2-cas7-cas5-cas6 operon. The designations in FIG. 23A, FIG. 23B, FIG. 23C, FIG. 23D, and FIG. 23E are described in this Example (as well as in Example 1) and are as follows: $P_{T7}$ (T7 promoter), lacO (Lac operator), His6 (hexahistidine), MBP (maltose binding protein), Strep-tag® II (IBA GMBH LLC, Göttingen, Germany) HRV3C (human rhinovirus 3C) protease recognition sequence, TEV (tobacco etch virus) protease recognition sequence, NLS (nuclear localization signal), kanR (kanamycin resistance gene), lacI (LacI repressor gene), colE1 ori (origin of replication), CDF ori (CloDF13 origin of replication), FokI nuclease domain (Sharkey variant), and aadA (gene encoding aminoglycoside resistance protein).

Table 19 provides sequences of bacterial expression plasmids encoding the Cas8 protein, the four proteins of the CasBCDE complex (cse2-cas7-cas5-cas6 operon), and all five proteins of the Cascade complex (cas8-cse2-cas7-cas5-cas6 operon). Polynucleotide sequences are provided with and without the N-terminal FokI fusion on the Cas8 protein.

TABLE 19

Bacterial Plasmid Sequences

| SEQ ID NO: | Vector designation | Arrangement of protein coding sequences (N to C) | Notable characteristics |
|---|---|---|---|
| SEQ ID NO: 438 | Cas8 expression vector | His6-MBP-TEV-Cas8 | Can be added to CasBCDE complex to reconstitute Cascade |
| SEQ ID NO: 439 | FokI-Cas8 expression vector | His6-MBP-TEV-NLS-Fok1-linker-Cas8 | FokI confers the ability to cleave double-stranded DNA |
| SEQ ID NO: 440 | CasBCDE complex expression vector | Strep-tag® II-HRV3C-Cse2_Cas7_Cas5_Cas6 | When co-expressed with a CRISPR array, generates CasBCDE complex |
| SEQ ID NO: 441 | Cascade complex expression vector | Cas8_His6-HRV3C-Cse2_Cas7_Cas5_Cas6 | When co-expressed with a CRISPR array, generates Cascade complex |
| SEQ ID NO: 442 | FokI-Cascade expression vector | NLS-FokI-linker-Cas8_His6-HRV3C-Cse2_Cas7_Cas5_Cas6 | FokI confers the ability to cleave double-stranded DNA targeted by crRNA |
| SEQ ID NO: 443 | FokI-Cascade expression vector, extra NLS tag | NLS-FokI-linker-Cas8_His6-HRV3C-Cse2_Cas7-NLS_Cas5_Cas6 | FokI confers the ability to cleave double-stranded DNA targeted by crRNA; extra |

TABLE 19-continued

Bacterial Plasmid Sequences

| SEQ ID NO: | Vector designation | Arrangement of protein coding sequences (N to C) | Notable characteristics |
|---|---|---|---|
| | | | NLS tag on Cas7 protein improves nuclear trafficking |

In order to purify the CasBCDE complex and Cascade complex containing a crRNA, the protein expression vectors encoding the cse2-cas7-cas5-cas6 operon or the cas8-cse2-cas7-cas5-cas6 operon are combined with a vector containing a minimal CRISPR array.

CRISPR arrays were cloned into the pACYC-Duet1 vector backbone, which confers chloramphenicol resistance due to the camR gene. Transcription of the array is driven by a T7 promoter and is under control of the Lac operator (lacO); the vector also encodes the LacI repressor. A T7 terminator was cloned downstream of the CRISPR array. The vector contains a p15A origin of replication.

Figure 24:
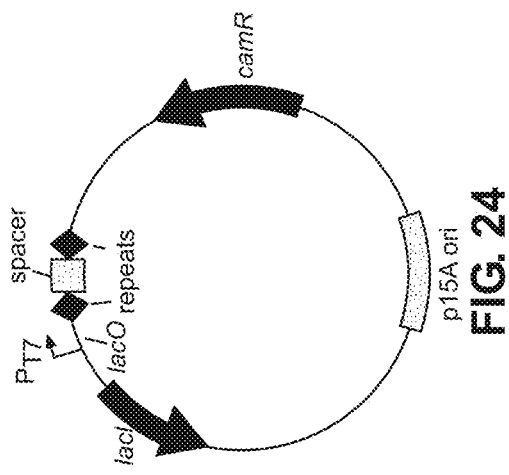

FIG. 24 contains a schematic diagram of an expression vector containing a CRISPR array with 2 repeats (FIG. 24, "repeats") and 1 spacer (FIG. 24, "spacer"). The array can be expanded, as described herein. The designations in FIG. 24 are described in this Example (as well as in Example 1) and are as follows: $P_{T7}$ (T7 promoter), lacO (Lac operator), lacI (LacI repressor gene), p15A ori (origin of replication), and camR (chloramphenicol resistance gene).

Table 20 provides the sequences of bacterial expression plasmids encoding examples of minimal CRISPR arrays.

TABLE 20

Bacterial Plasmid Sequences

| SEQ ID NO: | Vector designation | DNA targeted by spacer | Notable characteristics |
|---|---|---|---|
| SEQ ID NO: 444 | CRISPR(J3) expression vector | Bacteriophage λ J3 target | Two repeats, one spacer |
| SEQ ID NO: 445 | CRISPR(L3) expression vector | Bacteriophage λ L3 target | Two repeats, one spacer |
| SEQ ID NO: 446 | CRISPR(J3/L3) expression vector | Bacteriophage λ L3/J3 targets | Three repeats, two spacers |
| SEQ ID NO: 447 | CRISPR(TRAC) expression vector | TRAC gene | Three repeats, two spacers |

Example 3

Design of Eukaryotic Expression Vectors for Production of Cascade Effector Complexes in Mammalian Cells This Example describes the design of eukaryotic expression plasmid vectors that encode Cascade-associated proteins, as well as minimal CRISPR arrays comprising the component sequences as described in Example 1.

A. Separate Plasmids Expressing Each Cascade Protein and Minimal CRISPR Array

Cascade proteins can be expressed in mammalian cells by encoding each of the protein components on a separate expression vector driven by the human cytomegalovirus (CMV) immediate-early promoter/enhancer and encoding the crRNA on a separate expression vector driven by the human U6 promoter.

The starting plasmid for each expression plasmid was a derivative of pcDNA3.1 (Thermo Scientific, Wilmington, DE). Coding sequences for the Cascade proteins, codon-optimized for expression in human cells (see Example 1), were inserted into the vector downstream of the CMV promoter and upstream of a bovine growth hormone (bGH) polyadenylation signal. The cse2 gene was fused to polynucleotide sequences at the 5' end coding for an N-terminal NLS and 3×-FLAG epitope tag. The cas5 gene was fused to polynucleotide sequences at the 5' end coding for an N-terminal NLS. The cas6 gene was fused to polynucleotide sequences at the 5' end coding for an N-terminal NLS and HA epitope tag. The cas7 gene was fused to polynucleotide sequences at the 5' end coding for an N-terminal NLS and Myc epitope tag. The cas8 gene was fused to polynucleotide sequences at the 5' end coding for an N-terminal NLS; in another embodiment, the cas8 gene was fused to polynucleotide sequences at the 5' end coding for an N-terminal NLS, HA epitope tag, and FokI nuclease domain.

Each gene or gene fusion was cloned into a pcDNA3.1 derivative vector backbone, which confers ampicillin resistance due to the presence of the ampR gene. The vector also encodes neomycin resistance due to the presence of the neoR gene, which is downstream of an SV40 early promoter ($P_{SV40}$) and origin (SV40 ori), and upstream of an SV40 early polyadenylation signal (SV40 pA). In addition to the human CMV immediate-early promoter/enhancer ($P_{CMV}$) and bGH (bovine growth hormone) polyadenylation signal, the vector contains a T7 promoter upstream of the gene of interest, allowing for in vitro transcription of mRNA. The vector contains an f1 origin of replication as well as a ColE1 origin of replication.

Figure 25:
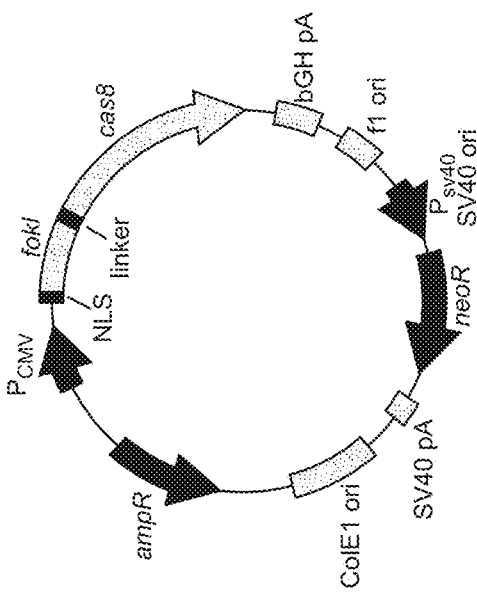

FIG. 25 contains a schematic diagram of a mammalian expression vector encoding the FokI-Cas8 fusion protein. The designations in FIG. 25 are described in this Example (as well as in Example 1) and are as follows: the human CMV immediate-early promoter/enhancer ($P_{CMV}$), NLS (nuclear localization signal), FokI (FokI nuclease domain (Sharkey variant)), Cas8 protein coding sequence, bGH pA (bovine growth hormone polyadenylation signal), f1 ori (f1 phage origin of replication), $P_{SV40}$ (SV40 early promoter), SV40 ori (SV40 origin), neoR (neomycin resistance gene), SV40 pA (SV40 early polyadenylation signal), colE1 ori (origin of replication), and ampR (ampicillin resistance gene). Vectors encoding the other Cascade proteins were designed similarly.

Table 21 provides the sequences of individual mammalian expression vectors encoding each of Cse2, Cas5, Cas6, Cas7, Cas8, and FokI-Cas8.

TABLE 21

Mammalian Expression Vectors

| SEQ ID NO: | Vector designation | Notable characteristics |
|---|---|---|
| SEQ ID NO: 448 | Mammalian Cse2 expression vector | Cse2 contains N-terminal NLS-3xFLAG tag |
| SEQ ID NO: 449 | Mammalian Cas5 expression vector | Cas5 contains N-terminal NLS |
| SEQ ID NO: 450 | Mammalian Cas6 expression vector | Cas6 contains N-terminal NLS-Ha tag |
| SEQ ID NO: 451 | Mammalian Cas7 expression vector | Cas7 contains N-terminal NLS-Myc tag |

TABLE 21-continued

Mammalian Expression Vectors

| SEQ ID NO: | Vector designation | Notable characteristics |
|---|---|---|
| SEQ ID NO: 452 | Mammalian Cas8 expression vector | Cas8 contains N-terminal NLS |
| SEQ ID NO: 453 | Mammalian FokI-Cas8 expression vector | Cas8 contains N-terminal NLS-HA-FokI; FokI confers the ability to cleave double-stranded DNA |

The CRISPR RNA was encoded with a minimal CRISPR array containing three repeats flanking two spacer sequences. The construct generating CRISPR RNA can be designed with additional sequences flanking the outermost repeats in the minimal array. Processing of the precursor CRISPR RNA is enabled by the RNA processing protein of the Cascade complex (Cas6 protein), which can be expressed on a separate plasmid.

The CRISPR array was cloned into the same pcDNA3.1 derivative vector backbone described above, except the human CMV promoter was replaced with the human U6 promoter ($P_{U6}$), and the bGH polyadenylation signal was replaced with a poly-T termination signal. An example of such a CRISPR array is illustrated in FIG. 35. In the figure, the hU6 promoter (FIG. 35, shown as a stippled region) is adjacent a first repeat sequence (clear square), that is adjacent a first spacer sequence (FIG. 35, spacer 1, slanted lines), that is adjacent a second repeat sequence (FIG. 35, grey square), that is adjacent a second spacer sequence (FIG. 35, spacer 2), that is adjacent a third repeat sequence (FIG. 35, black square). In FIG. 35, the region comprising the paired gRNA guides is shown (FIG. 35, paired gRNAs).

Figure 26:
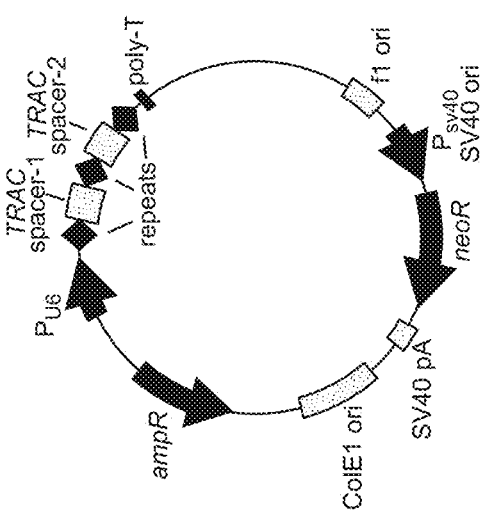

FIG. 26 contains a schematic diagram of a eukaryotic expression vector encoding a representative CRISPR array targeting the TRAC gene. The designations in FIG. 26 are described in this Example (as well as in Example 1) and are as follows: $P_{U6}$ (human U6 promoter), repeats (CRISPR RNA repeats), TRAC spacer-1 (first spacer targeting the TRAC gene), TRAC spacer-2 (second spacer targeting the TRAC gene), polyT (poly-T termination signal), f1 ori (f1 phage origin of replication), $P_{SV40}$ (SV40 early promoter), SV40 ori (SV40 origin), neoR (neomycin resistance gene), SV40 pA (SV40 early polyadenylation signal), colE1 ori (origin of replication), and ampR (ampicillin resistance gene).

Table 22 provides the sequence of a representative mammalian expression vector encoding a CRISPR array targeting the TRAC gene; a spacer sequence that targets matching DNA sequences in the TRAC gene can be found in Table 18.

TABLE 22

Mammalian Expression Vector

| SEQ ID NO: | Vector designation | Spacer complementary to target | Notable characteristics |
|---|---|---|---|
| SEQ ID NO: 454 | Mammalian CRISPR RNA expression vector | TRAC gene | Three repeats, two spacers |

B. Cascade Protein Expression System Wherein Multiple Cascade Protein Coding Sequences are Expressed from a Single Promoter In order to express components of the Cascade complex from fewer expression vectors, polycistronic expression vectors were constructed. On each, a single CMV promoter drives expression of multiple coding sequences simultaneously that are separated by a 2A viral peptide sequence. The *Thosea asigna* virus 2A peptide sequence induces ribosomal skipping (see, e.g., Liu, Z., et al., Sci. Rep. 7:2193 (2017)), thus enabling multiple protein-coding genes to be concatenated within a single polycistronic construct.

The starting plasmid for the polycistronic expression plasmid was the same derivative of pcDNA3.1 described above, containing the CMV promoter and bGH polyadenylation signal. Coding sequences for the Cascade proteins, codon-optimized for expression in human cells (see Example 1), were joined in the order cas7-cse2-cas5-cas6-cas8, with a polynucleotide sequence coding for the *Thosea asigna* virus 2A (T2A) peptide inserted in between each pair of genes. In addition, polynucleotide sequences encoding NLS tags were appended to the 5' end of each Cascade protein gene, and a polynucleotide sequence encoding the FokI nuclease domain was appended to the 5' end of the cas8 gene, connecting by a 30-amino acid linker sequence. The final construct has the following order of elements: NLS-cas7-T2A-NLS-cse2-T2A-NLS-cas5-T2A-NLS-cas6-T2A-NLS-fokI-linker-cas8.

Figure 27:
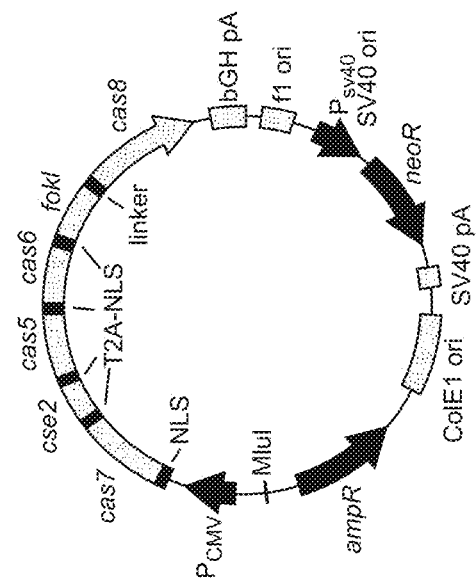

FIG. 27 contains a schematic diagram of an exemplary polycistronic mammalian expression vector encoding all the Cascade proteins. The designations in FIG. 27 are described in this Example (as well as in Example 1) and are as follows: the human CMV immediate-early promoter/enhancer ($P_{CMV}$), NLS (nuclear localization signal), T2A (polynucleotide sequence coding for the *Thosea asigna* virus 2A peptide), coding sequences for the Cas7, Cse2, Cas5, and Cas6 proteins, fokI (FokI nuclease domain (Sharkey variant) a linker sequence, coding sequence for Cas8 protein, bGH pA (bovine growth hormone polyadenylation signal), f1 ori (f1 phage origin of replication), $P_{SV40}$ (SV40 early promoter), SV40 ori (SV40 origin), neoR (neomycin resistance gene), SV40 pA (SV40 early polyadenylation signal), colE1 ori (origin of replication), ampR (ampicillin resistance gene), and an MluI restriction site.

Table 23 provides the sequence of an exemplary polycistronic mammalian expression vector encoding all the Cascade proteins. This vector can be combined with the mammalian expression vector encoding CRISPR RNA described above to produce functional Cascade complexes in mammalian cells.

TABLE 23

Mammalian Expression Vectors

| SEQ ID NO: | Vector designation | Arrangement of protein coding sequences (N to C) | Notable characteristics |
|---|---|---|---|
| SEQ ID NO: 455 | Polycistronic mammalian expression vector encoding all five Cascade proteins | NLS-Cas7-T2A_ NLS-Cse2-T2A_ NLS-Cas5-T2A_ NLS-Cas6-T2A_ NLS-FokI-Cas8 | Single protein expression vector encoding all Cascade proteins, each with N-terminal NLS tag. Cas8 contains N-terminal NLS-HA-FokI; FokI confers the ability to cleave double-stranded DNA |

C. Single Plasmid Expression System

A single-plasmid Cascade expression system was constructed to express the complete Cascade complex in human cells. The plasmid encodes the entire cas8-cse2-cas7-cas5-cas6 operon and a minimal CRISPR array on a single plasmid. This plasmid was constructed from the polycistronic protein expression vector (described in Table 23 and FIG. 27) by inserting the minimal CRISPR array along with the upstream human U6 promoter and downstream poly-T termination signal into the MluI restriction site.

Table 24 provides the sequence of the single plasmid for expression of all five Cascade proteins together with the crRNA to facilitate formation of Cascade complexes in human cells.

TABLE 24

Mammalian Expression Vector

| SEQ ID NO: | Vector designation | Arrangement of protein coding sequences (N to C) | Notable characteristics |
|---|---|---|---|
| SEQ ID NO: 456 | Polycistronic mammalian expression vector encoding all five Cascade proteins and crRNA | hU6_CRISPR(TRAC), CMV_NLS-Cas7-T2A_NLS-Cse2-T2A_NLS-Cas5-T2A_NLS-Cas6_NLS-FokI-Cas8 | Single protein expression vector encoding crRNA and all Cascade proteins, each with N-terminal NLS tag. Cas8 contains N-terminal NLS-HA-FokI; FokI confers the ability to cleave double-stranded DNA |

Plasmids were also designed for the expression of the Cas3 protein (SEQ ID NO:21; monomer Cas3 nuclease/helicase *E. coli* K-12 substr. MG1655) in *E. coli* and in mammalian cells. Table 25 provides the constructs and sequences of these plasmids.

TABLE 25

Cas3 Protein Fusions

| SEQ ID NO: | Protein | Notable characteristics |
|---|---|---|
| SEQ ID NO: 457 | Cas3 | gDNA gene sequence |
| SEQ ID NO: 458 | Cas3 | Protein amino acid sequence |
| SEQ ID NO: 459 | His6-MBP-TEV-Cas3 | Derived from gDNA gene sequence |
| SEQ ID NO: 460 | His6-MBP-TEV-Cas3 | Protein amino acid sequence |
| SEQ ID NO: 461 | His6-MBP-TEV-Cas3 | Cas3 *E. coli* expression vector |
| SEQ ID NO: 462 | Cas3, human codon-optimized | *H. sapiens* codon-optimized DNA gene sequence |
| SEQ ID NO: 463 | Cas3-NLS | *H. sapiens* codon-optimized DNA gene sequence |
| SEQ ID NO: 464 | Cas3-NLS | Protein amino acid sequence |
| SEQ ID NO: 465 | Cas3-NLS | Cas3 mammalian expression vector |

Example 4

Introduction of Polynucleotides Encoding Cascade Components into a Bacterial Production Strain This Example describes for introduction and expression of Cas8 subunit protein coding sequences, as well as coding sequences for components of engineered Type I CRISPR-Cas effector complexes in bacterial cells using *E. coli* expression systems.

A. Expression of Cas8 Protein

*E. coli* Type I-E Cas8 protein was expressed from a plasmid (Example 2, SEQ ID NO:438, Table 19, FIG. 23A) containing an operon for the IPTG inducible expression of His6-MBP-TEV-Cas8 from a T7 promoter. The expression plasmid conferred resistance to kanamycin.

In order to express Cas8 protein, *E. coli* cells were transformed with the expression plasmid. Briefly, a 100 μL aliquot of chemically competent *E. coli* cells (*E. coli* BL21 Star™ (Thermo Fisher Scientific, Waltham, MA) cells) in a microcentrifuge tube was thawed on ice for 10 minutes. 35 ng of plasmid DNA was added to the thawed cells and the cells were incubated with the DNA on ice for 8 minutes. Heat shock was performed by a placing the microcentrifuge tube in a 42° C. water bath for 30 seconds and then immediately placing the tube in ice for 2 minutes. 900 μL of 2×YT media were added to the microcentrifuge tube, and the microcentrifuge tube was placed in a tube rotator at 37° C. for 1 hour. Finally, 100 μL of the recovered cells were plated on LB solid kanamycin (50 μg/mL) and incubated overnight at 37° C.

A single colony was picked from the colonies that grew on the antibiotic selection plates and was inoculated into 10 mL of 2×YT media supplemented with kanamycin (50 μg/mL). The culture was grown overnight at 37° C. while shaking in an orbital shaker at 200 RPMs. 6 mL of the overnight culture were transferred to a 2 L baffled flask having 1 L of 2×YT media supplemented with kanamycin (50 μg/mL). The 1 L culture was grown at 37° C. while shaking in an orbital shaker at 200 RPM until the optical density at 600 nm was 0.56.

Expression was then induced by the addition of IPTG to a final concentration of 1 mM. The induced cultures were grown overnight at 16° C. while shaking in an orbital shaker at 200 RPM. Cells were harvested by centrifugation at 4,000 RCF for 15 minutes at 4° C. The cell pellet was re-suspended in 15 mL of a lysis buffer composed of 50 mM Tris pH 7.5, 100 mM NaCl, 5% glycerol, and 1 mM TCEP supplemented with 1 Complete™ (Roche, Basel, Switzerland) protease inhibitor tablet per 50 mL of lysis buffer. The re-suspended cells were transferred to a 50 mL conical tube for immediate downstream processing. The Cas8 protein was purified and the purified protein characterized essentially as described below for the FokI-Cas8 fusion protein (Example 5C).

B. Expression of the Components of Cascade RNP Complexes

A complete set of the five *E. coli* Cascade proteins and RNA guides were co-expressed in *E. coli* cells using a two-plasmid system to produce Cascade RNP complexes. One plasmid (Example 2, SEQ ID NO:441, Table 19, FIG. 23D) contained an operon for IPTG inducible expression of the Cse2, Cas5, Cas6, Cas7, and Cas8 proteins from a T7 promoter. A His6 affinity tag was included as a translational fusion to the N-terminus of Cse2 (Example 1, SEQ ID NO:392, Table 16). The second plasmid coded for the IPTG inducible expression of the J3 guide (Example 2, SEQ ID NO:444, Table 20, FIG. 24). The Cascade protein expression plasmid conferred spectinomycin resistance, and the Cascade RNA guide expression plasmid conferred chloramphenicol resistance.

In order to co-express the Cascade proteins and RNA components in the same cell, *E. coli* cells were simultaneously transformed with the two plasmids. A 100 µL aliquot of chemically competent *E. coli* cells (*E. coli*, BL21 Star™ (DE3) (Thermo Fisher Scientific, Waltham, MA)) in a microcentrifuge tube was thawed on ice for 10 minutes. 35 ng of each plasmid was added to the thawed cells and the cells were incubated with the DNA on ice for 8 minutes. Heat shock was performed by a placing the microcentrifuge tube in a 42° C. water bath for 30 seconds and then immediately placing the microcentrifuge tube in ice for 2 minutes. 900 µL of 2×YT media were added to the microcentrifuge tube and the microcentrifuge tube placed in a tube rotator at 37° C. for 1 hour. Finally, 100 µL of the recovered cells were plated on LB solid media with chloramphenicol (34 µg/mL) and spectinomycin (50 µg/mL) and incubated overnight at 37° C.

A single colony was picked from the colonies that grew on the antibiotic selection plates and was inoculated into 10 mL of 2×YT media supplemented with chloramphenicol (34 µg/mL) and spectinomycin (100 µg/mL). The culture was grown overnight at 37° C. while shaking in an orbital shaker at 200 RPMs. 6 mL of the overnight culture were transferred to a 2 L baffled flask having 1 L of 2×YT media supplemented with chloramphenicol (34 µg/mL) and spectinomycin (100 µg/mL). The 1 L culture was grown at 37° C. while shaking in an orbital shaker at 200 RPM until the optical density at 600 nm was 0.56.

Expression from both plasmids was induced by the addition of IPTG to a final concentration of 1 mM. The induced cultures were grown overnight at 16° C. while shaking in an orbital shaker at 200 RPM. Cells were harvested by centrifugation for at 4,000 RCF for 15 minutes at 4° C. The cell pellet was re-suspended in 15 mL of lysis buffer composed of 50 mM Tris pH 7.5, 100 mM NaCl, 5% glycerol, and 1 mM TCEP supplemented with 1 Complete™ (Roche, Basel, Switzerland) protease inhibitor tablet per 50 mL of lysis buffer. The re-suspended cells were transferred to a 50 mL conical tube for immediate downstream processing. Cascade RNP complexes were purified and characterized as described below.

Example 5

Purification of Cascade Components and Cascade RNP Complexes

This Example describes a method to purify *E. coli* Type I-E Cascade RNP complexes produced by overexpression in bacteria as described in Example 4B. The method uses immobilized metal affinity chromatography followed by size exclusion chromatography (SEC). This Example also describes the methods used to assess the quality of the purified Cascade RNP product. In addition, this Example describes purification and characterization of Cascade components.

A. Purification of Cas8, Cas7, Cas6, Cas5, and Cse2 Cascade RNP Complexes

*E. coli* Type I-E Cascade RNP complexes were produced as described in Example 4B. The Cascade complexes were captured using immobilized metal affinity chromatography. Briefly, the re-suspended cell pellets, produced as described in Example 4B, were thawed on ice and the volume was brought to 35 mL by of an additional 15 mL of lysis buffer composed of 50 mM Tris pH 7.5, 100 mM NaCl, 5% glycerol, and 1 mM TCEP supplemented with 1 Complete™ (Roche, Basel, Switzerland) protease inhibitor tablet per 50 mL of lysis buffer.

The 50 mL conical tube was placed in an ice water bath and the cells were lysed by two rounds of sonication using a Q500 sonicator with a ½ inch tip (Qsonica, Newtown, CT). Each round of sonication consisted of a treatment cycle of 2.5 minutes with repeating cycles of 10 seconds of sonication at 50% amplitude followed by 20 seconds of rest. The tube was allowed to cool in the ice water bath for one minute between rounds of sonication. The lysates were clarified by centrifugation at 48,384 RCF for 30 minutes at 4° C. The clarified supernatant was then added to a Hispur™ Ni-NTA (Thermo Fisher Scientific, Waltham, MA) resin, that had been pre-equilibrated with Ni-wash buffer composed of 50 mM Tris pH 7.5, 100 mM NaCl, 10 mM imidazole, 5% glycerol, and 1 mM TCEP. A 1.5 mL bed volume of nickel affinity resin was used for each 1 L of *E. coli* expression culture. After one hour of incubation at 4° C. with gentle mixing, the resin was pelleted by centrifugation at 500 RCF for 2 minutes at 4° C. The supernatant was aspirated and the resin was washed 5 times with 5 bed volumes of Ni-wash buffer. After each wash the resin was pelleted at 500 RCF for 2 minutes at 4° C. and the supernatant was removed by aspiration. Finally, bound proteins (including the Cascade RNP complexes) were eluted by the addition of five bed volumes of Ni-elution buffer composed of 50 mM Tris pH 7.5, 100 mM NaCl, 300 mM imidazole, 5% glycerol, and 1 mM Tris(2-carboxyethyl)phosphine (TCEP). After centrifugation at 500 RCF for 2 minutes at 4° C., the nickel affinity eluate was aspirated into a clean 50 mL conical tube.

The nickel affinity eluate was further purified by size exclusion chromatography (SEC). The nickel affinity eluate was concentrated to a final volume of 0.5 mL by ultrafiltration at 12° C. using an Amicon® (MilliporeSigma, Billerica, MA) ultrafiltration spin concentrator with an Ultracel®-50 (MilliporeSigma, Hayward, CA) membrane. The concentrated sample was filtered using a 0.22 µM Ultrafree-MC GV (MilliporeSigma, Hayward, CA) centrifugal filter before being further purified by separation at 4° C. with a flow rate of 0.5 mL/minute on a HiPrep™ 16/60 Sephacryl® S-300 (GE Healthcare, Uppsala, Sweden) column equilibrated with SEC buffer composed of 50 mM Tris pH 7.5, 500 mM NaCl, 5% glycerol, 0.1 mM EDTA, and 1 mM TCEP. Proteins were eluted with SEC buffer and 1 ml fractions were collected. The earliest eluting peak, as judged by UV 280, was assumed to be high molecular weight aggregated material and the corresponding fractions were discarded. Subsequent elution fractions were analyzed by Coomassie stained SDS-PAGE. Each properly formed complex contained one molecule of Cas8, six molecules of Cas7, one molecule each of Cas6 and Cas5, and two molecules of Cse2. Elution fractions that had the approximate expected stoichiometry of Cascade proteins, when visualized on the SDS-PAGE gel, were pooled. Pooled fractions were analyzed spectrophotometrically to confirm they contained a significant nucleic acid component, as evidenced by an absorbance at 260 nm that is greater than the absorbance at 280 nm.

The pooled samples were exchanged into storage buffer composed of 50 mM Tris pH 7.5, 100 mM NaCl, 5% glycerol, 0.1 mM EDTA, and 1 mM TCEP by concentrating the pooled samples to 100 uL with an Amicon® (MilliporeSigma, Hayward, CA) spin concentrator with an Ultracel®-50 (MilliporeSigma, Hayward, CA) membrane and then diluting 50-fold with the storage buffer. Finally, the sample was concentrated to 10 mg/mL using the same ultrafiltration device and stored at −80° C.

The final purified product was analyzed spectrophotometrically to determine the final concentration of the Cascade RNP complexes and to confirm the presence of a nucleic acid component as evidenced by an absorbance at 260 nm that is greater than the absorbance at 280 nM. The concentration of the Cascade RNP complexes was determined by dividing the absorbance at 280 nm by the calculated absorbance of a 0.1% solution of the intact complex with a 1 cm path length. The predicted absorbance of a 0.1% solution of the purified complex is 2.03 $cm^{-1}$ and was calculated by dividing the sum of the calculated extinction coefficients at 280 nm for each of the molecules in the complex (916940 $M^{-1}cm^{-1}$) by the sum of the molecular weights of each of the molecules in the complex (450832 g/mole).

Additionally, the final product was analyzed by SDS-PAGE with Coomassie blue staining to confirm that each protein component was present in approximately the correct stoichiometry, and to assess the presence of contaminating proteins. SDS-PAGE gels were stained with a Coomassie InstantBlue™ (Expedeon, San Diego, CA) stain. Gels were imaged using a Gel Doc™ EZ (Bio-Rad, Hercules, CA) imager and annotated using ImageLab (Bio-Rad, Hercules, CA) software.

B. Purification of Cascade Complexes Comprising Cas7, Cas6, Cas5, and Cse2 Proteins A Cascade complex composed of the and the protein components Cas7, Cas6, Cas5, and Cse2 was purified. The L3 guide RNA (Example 2, SEQ ID NO:445, Table 20) was expressed from a first plasmid (Example 2, FIG. 24) essentially as described in Example 4B. The Cascade proteins were expressed from a second plasmid (Example 2, SEQ ID NO:440, Table 19, FIG. 23C) essentially as described in Example 4B.

The complex was captured using affinity chromatography. Re-suspended cell pellets were thawed on ice. In a 50 mL conical tube, the volume was brought up to 35 mL with an additional 15 mL of lysis buffer composed of 50 mM Tris pH 7.5, 100 mM NaCl, 5% glycerol, 1 mM TCEP, and supplemented with 1 Complete™ (Roche, Basel, Switzerland) protease inhibitor tablet per 50 mL of lysis buffer. The 50 mL conical tube was placed in an ice water bath, and the cells were lysed by six rounds of sonication using a Q500 sonicator with a ½ inch tip (Qsonica, Newtown, CT). Each round of sonication consisted of a 1-minute treatment cycle with repeating cycles of 3 seconds of sonication at 90% amplitude followed by 9 seconds of rest. The tube was allowed to cool in the ice water bath for one minute between rounds of sonication. The lysate was clarified by centrifugation at 48,384 RCF for 30 minutes at 4° C. The clarified supernatant was affinity purified by addition of Strep-Tactin® Sepharose® (IBA GMBH LLC, Göttingen, Germany) resin that had been pre-equilibrated with Strep-wash buffer composed of 50 mM Tris pH 7.5, 100 mM NaCl, 1 mM EDTA, 5% glycerol, and 1 mM TCEP. A 0.55 mL bed volume of affinity resin was used for each 1 L of E. coli expression culture. After one hour of incubation at 4° C. with gentle mixing, the sample was poured onto a 30 mL disposable gravity flow column (Bio-Rad, Hercules, CA) allowing the unbound material to flow through the column. The resin was washed five times with five bed volumes of Strep-wash buffer. Finally, the bound proteins were eluted with two sequential additions of five bed volumes of Strep-elution buffer composed of 50 mM Tris pH 7.5, 100 mM NaCl, 2.5 mM Desthiobiotin, 5% glycerol, 1 mM EDTA, and 1 mM TCEP.

The affinity eluate was further purified by SEC. The affinity eluate was concentrated to a final volume of 550 uL by ultrafiltration at 12° C. using an Amicon® (MilliporeSigma, Hayward, CA) spin concentrator with an Ultracel®-50 (Millipore Sigma, Hayward, CA) membrane. The concentrated sample was filtered using a 0.22 μm 13 mm UltraCruz® (Santa Cruz Biotechnology, Dallas, TX) PVDF syringe filter before being further purified by separation at 4° C. with a flow rate of 0.4 mL/minute on a HiPrep™ 16/60 Sephacryl® S-300 (GE Healthcare, Uppsala, Sweden) column equilibrated with SEC buffer composed of 50 mM Tris pH 7.5, 500 mM NaCl, 5% glycerol, 0.1 mM EDTA, and 1 mM TCEP. Protein was eluted with SEC buffer and 0.75 ml fractions were collected. The earliest eluting peak, as judged by UV 280, was assumed to be high molecular weight aggregated material and the corresponding fractions were discarded. Fractions corresponding to the second peak (a shoulder on the back side of the first UV 280 peak) were pooled.

The pooled samples were exchanged into storage buffer composed of 50 mM Tris pH 7.5, 100 mM NaCl, 5% glycerol, 0.1 mM EDTA, and 1 mM TCEP by concentrating down to 200 uL with an Amicon® (MilliporeSigma, Hayward, CA) spin concentrator with an Ultracel®-50 (MilliporeSigma, Hayward, CA) membrane and then diluting 75-fold with storage buffer. The sample was concentrated a second time to 700 uL and again diluted 20-fold with storage buffer. Finally, the sample was concentrated to 4.7 mg/mL in the same ultrafiltration device and stored at −80° C.

The final purified product was analyzed spectrophotometrically to determine the final concentration of the Cascade RNP complexes and to confirm the presence of a nucleic acid component as evidenced by an absorbance at 260 nm that is greater than the absorbance at 280 nM. The concentration of the Cascade RNP complexes was determined by dividing the absorbance at 280 nm by the calculated absorbance of a 0.1% solution of the intact complex with a 1 cm path length. The predicted absorbance of a 0.1% solution of the purified complex is 2.18 $cm^{-1}$ and was calculated by dividing the sum of the calculated extinction coefficients at 280 nm for each molecule in the complex (762240 $M^{-1}cm^{-1}$) by the sum of the molecular weights of each molecule in the complex (348952.07 g/mole).

Additionally, the final product was analyzed by SDS-PAGE with Coomassie blue staining to confirm that each Cascade protein was present in approximately the correct stoichiometry, and to assess the presence of contaminating proteins. SDS-PAGE gels were stained with Coomassie InstantBlue™ (Expedeon, San Diego, CA) stain. Gels were imaged using a Gel Doc™ EZ (Bio-Rad, Hercules, CA)

imager and annotated using ImageLab (Bio-Rad, Hercules, CA) software. Each properly formed complex contained six molecules of Cas7, one molecule each of Cas6 and Cas5, and two molecules of Cse2.

C. Purification of FokI-Cas8 Fusion Protein

A method used to purify a fusion protein comprising a FokI nuclease fusion to the *E. coli* Type I-E Cas8 protein from bacterial over-expression pellets using immobilized metal affinity chromatography, cation exchange chromatography (CIEX), and finally size exclusion chromatography (SEC) is described herein.

The *E. coli* Type I-E FokI-Cas8 fusion protein, including a linker sequence, is described in Example 1 (SEQ ID NO:413, Table 16). The expression plasmid is described in Example 2 (SEQ ID NO:439, Table 19, FIG. 23B). Cells comprising the fusion protein were produced essentially as described in Example 4A. The Cas8 fusion protein contained a N-terminal His6 tag, a Maltose binding protein domain, a TEV cleavage site, a FokI nuclease domain, and a 30-amino acid linker. The protein was captured using immobilized metal affinity chromatography. A 50 mL conical tube containing the re-suspended cell pellets was thawed on ice. The tube was then placed in an ice water bath, and the cells were lysed by sonication using a Q500 sonicator with a ¼ inch tip (Qsonica, Newtown, CT) for a treatment cycle of three minutes with repeating cycles of 10 seconds of sonication at 40% amplitude followed by 20 seconds of rest. The lysates were clarified by centrifugation at 30,970 RCF for 30 minutes at 4° C. The clarified supernatant was then added to Hispur™ Ni-NTA (Thermo Fisher Scientific, Waltham, MA) resin, that had been pre-equilibrated with Ni-wash buffer composed of 50 mM Tris pH 7.5, 100 mM NaCl, 10 mM imidazole, 5% glycerol, and 1 mM TCEP. A 2 mL bed volume of nickel affinity resin was used for 1 L of *E. coli* expression culture. After one hour of incubation at 4° C. with gentle mixing, the sample was poured onto a 30 mL disposable gravity flow column (Bio-Rad, Hercules, CA), allowing the unbound material to flow through the column. The resin was washed five times with five bed volumes of Ni-wash buffer. Finally, the bound proteins were eluted with five bed volumes of Ni-elution buffer composed of 50 mM Tris pH 7.5, 100 mM NaCl, 300 mM imidazole, 5% glycerol, and 1 mM TCEP.

The nickel affinity eluate was treated with TEV protease to remove the affinity tag. TEV protease was added to the eluate at a ratio of 1:25 (w/w). The sample, including TEV, was dialyzed overnight against Ni-wash buffer using a 12 mL Slid-A-Lyzer™, 10K MWCO (Thermo Fisher Scientific, Waltham, MA) dialysis cassette.

The TEV protease and the cleaved His6-MBP fragment were removed from the dialyzed sample by Ni affinity chromatography. The dialyzed sample was poured over a clean Hispur™ Ni-NTA (Thermo Fisher Scientific, Waltham, MA) resin column equilibrated with Ni-wash buffer. The resin was then washed with 1 column volume of Ni-NTA wash buffer. The flow through and wash were combined, concentrated, and exchanged into storage buffer (50 mM Tris pH 7.5, 500 mM NaCl, 5% glycerol, and 1 mM TCEP) using an Amicon® (MilliporeSigma, Hayward, CA) spin concentrator with an Ultracel®-10 (MilliporeSigma, Hayward, CA) membrane. This sample was then frozen at −80 C for storage.

The sample was thawed and further purified by cation exchange chromatography (CIEX). The sample was thawed on ice and diluted 10-fold from 0.475 mL to 4.75 mL with Cold CIEX_A buffer composed of 50 mM Tris pH 7.5, 5% glycerol, and 1 mM TCEP, resulting in a final concentration of 50 mM NaCl. A 10 mL capillary loop was used to load the sample onto a 1 mL Hitrap™ SP HP (GE Healthcare, Uppsala, Sweden) column, equilibrated with a buffer comprising CIEX_A buffer and 5% CIEX_B buffer (50 mM Tris pH 7.5, 1 M NaCl, 5% glycerol, and 1 mM TCEP). The flow rate throughout the separation was of 0.75 mL/min. The loop was emptied onto the column with 15 mL of with 5% CIEX_B buffer. The unbound sample was washed out with an additional 2 mL of 5% CIEX_B buffer. 500 μL fractions were collected as the bound proteins were eluted with an 8 mL linear gradient from 5% to 65% CIEX_B buffer. There were two major UV280 elution peaks. The four fractions corresponding to the first of those two peaks were pooled. The total pooled volume was 2 mL.

The pooled CIEX fractions were further purified by SEC. The pooled CIEX fractions were concentrated to a final volume of 0.3 mL by ultrafiltration at 12° C. using an Amicon® (MilliporeSigma, Hayward, CA) spin concentrator with an Ultracel®-10 (MilliporeSigma, Hayward, CA) membrane. The concentrated sample was filtered using a 0.22 μm Ultrafree-MC GV Centrifugal (Millipore Sigma, Hayward, CA) spin filter (and further purified by separation at 4° C. with a flow rate of 0.6 mL/minute on a 10/300 Superdex™ 200 GL Increase (GE Healthcare, Uppsala, Sweden) column equilibrated with a Cas8 SEC buffer (50 mM Tris pH 7.5, 200 mM NaCl, 5% glycerol, and 1 mM TCEP). The protein was eluted with the Cas8 SEC buffer and 0.5 ml fractions were collected. The earliest eluting peak, as judged by UV 280, was assumed to be high molecular weight aggregated material and the corresponding fractions were discarded. A second major UV 280 peak was eluted after about 14 mL. The fractions corresponding to this second peak were pooled. The pooled samples were concentrated to 40 μL with an Amicon® (MilliporeSigma, Hayward, CA) spin concentrator with an Ultracel®-3 (MilliporeSigma, Hayward, CA) membrane. The concentrated sample was stored at −80° C.

The final purified product was analyzed spectrophotometrically to determine the final concentration of the fusion protein and to confirm the absence of a significant nucleic acid component as evidenced by an absorbance at 280 nm that is greater than the absorbance at 260 nm. The concentration of the FokI-Cas8 fusion was determined by dividing the absorbance at 280 nm by the calculated absorbance of a 0.1% solution of the intact complex. The predicted absorbance of a 0.1% solution of the purified complex is 1.05 $cm^{-1}$ and was calculated by dividing extinction coefficient at 280 nm for the FokI-Cas8 fusion (86290 $M^{-1}cm^{-1}$) by its molecular weight (82171.32 g/mole). Additionally, the final product was analyzed by SDS-PAGE gels stained with InstantBlue™ (Expedeon, San Diego, CA) stain. Gels were imaged using a Gel Doc™ EZ (Bio-Rad, Hercules, CA) imager and annotated using ImageLab (Bio-Rad, Hercules, CA) software. This analysis demonstrates that the purified fusion protein was the expected size and that only a low level of contaminating proteins was present.

Example 6

Production of dsDNA Target Sequences for Use in Biochemical Cleavage Assays dsDNA target sequences for use in in vitro DNA binding or cleavage assays with Cascade or Cascade-fusion effector complexes can be produced using several different methods. This Example describes three methods to produce target sequences, including annealing of synthetic ssDNA oligonucleotides, PCR amplification of selected nucleic acid target sequences from gDNA, and/or cloning of nucleic acid target sequences into bacterial plasmids. The dsDNA target sequences were used in Cascade binding or cleavage assays.

A. Production of dsDNA Target Sequences by Annealing Synthetic ssDNA Oligonucleotides DNA oligonucleotides encoding the target region of interest comprising the target sequence that is recognized by the guide portion of CRISPR RNA, the neighboring protospacer adjacent motif (PAM), and additional 5' and 3' flanking sequences were purchased from a commercial manufacturer (Integrated DNA Technologies, Coralville, IA). Two oligonucleotides were ordered per construct, one comprising the sense strand and one comprising the nonsense strand. Table 26 lists oligonucleotide sequences that were ordered to contain a target sequence denoted J3, which is derived from bacteriophage lambda gDNA. The target and PAM sequences are flanked by 20 bp of additional sequence on both the 5' and 3' ends.

TABLE 26 ssDNA Oligonucleotides

| Seq ID NO: | Description | Sequence |
|---|---|---|
| SEQ ID NO: 466 | Forward oligo, J3 target sequence | ATCATCCTCCTGACAATTTTGACAGCCCACATGGC ATTCCACTTATCACTGGCATCTTTAAAAGCCAGGA CGGTC |
| SEQ ID NO: 467 | Reverse oligo, J3 target sequence | GACCGTCCTGGCTTTTAAAGATGCCAGTGATAAGT GGAATGCCATGTGGGCTGTCAAAATTGTCAGGAG GATGAT |

The oligonucleotides were annealed by mixing both oligonucleotides at equimolar concentration (10 μM) in 1× annealing buffer (6 mM HEPES, pH 7.0, and 60 mM KCl), heating at 95° C. for 2 minutes, and then slow cooling. Annealed oligonucleotides were then used directly in DNA binding and/or DNA cleavage assays with Cascade and/or Cascade-effector domain fusion RNPs.

5' Cy5 fluorescently-labeled DNA oligonucleotides encoding the target region of interest comprising both the target sequence recognized by the guide portion of CRISPR RNA, as well as the flanking neighboring protospacer adjacent motif (PAM), and additional 5' and 3' flanking sequences, were purchased from a commercial manufacturer (Integrated DNA Technologies, Coralville, IA). Four oligonucleotides were ordered per construct, one comprising the 5' fluorescent-labeled sense strand, one comprising the 5' unlabeled sense strand, one comprising the 5' fluorescent-labeled nonsense strand, and one comprising the 5'unlabeled nonsense strand. The target and PAM sequences are flanked by 20 bp of additional sequence on both the 5' and 3' ends.

Table 27 lists oligonucleotide sequences that were ordered to contain a target sequence denoted J3, which was derived from bacteriophage lambda gDNA and a control target sequence denoted CCR5, which was derived from the human CCR5 locus.

TABLE 27 ssDNA Oligonucleotides for Fluorescently Labeled dsDNA Target Sequence Formation

| SEQ ID NO: | Description | Sequence |
|---|---|---|
| SEQ ID NO: 468 | target strand J3 | 5'CGCCGAGCTCGAATTCTTTTGACAGCCCACATG GCATTCCACTTATCACTGGCATGGATCCTGGCTG TGGTGATG |
| SEQ ID NO: 469 | non target strand J3 | 5'CATCACCACAGCCAGGATCCATGCCAGTGATA AGTGGAATGCCATGTGGGCTGTCAAAAGAATTC GAGCTCGGCG |
| SEQ ID NO: 470 | target strand CCR5 Site | 5'CGCCGAGCTCGAATTCTTTTTAGGTACCTGGCT GTCGTCCATGCTGTGTTTGCATGGATCCTGGCTG TGGTGATG |
| SEQ ID NO: 471 | non target strand CCR5 | 5'CATCACCACAGCCAGGATCCATGCAAACACAG CATGGACGACAGCCAGGTACCTAAAAAGAATTC GAGCTCGGCG |

TABLE 27-continued ssDNA Oligonucleotides for Fluorescently Labeled dsDNA Target Sequence Formation

| SEQ ID NO: | Description | Sequence |
|---|---|---|
| SEQ ID NO: 472 | target strand J3 | 5'Cy5-CGCCGAGCTCGAATTCTTTTGACAGCCCACATGGCATTCCACTTATCACTGGCATGGATCCTGGCTGTGGTGATG |
| SEQ ID NO: 473 | non target strand J3 | 5'Cy5-CATCACCACAGCCAGGATCCATGCCAGTGATAAGTGGAATGCCATGTGGGCTGTCAAAAGAATTCGAGCTCGGCG |
| SEQ ID NO: 474 | target strand CCR5 Site | 5'Cy5-CGCCGAGCTCGAATTCTTTTTAGGTACCTGGCTGTCGTCCATGCTGTGTTTGCATGGATCCTGGCTGTGGTGATG |

The oligonucleotides were annealed by mixing a labeled and unlabeled or two labeled or two unlabeled oligonucleotides at equimolar concentration (1 μM) in 1× annealing buffer (6 mM HEPES, pH 7.0, 60 mM KCl), heating at 95° C. for 2 minutes, and then slow cooling. Annealed oligonucleotides were then used directly in DNA binding assays with Cascade and/or Cascade-effector domain fusion RNPs. Cy5 fluorescently-labeled DNA oligonucleotides were imaged with an AZURE c600 (Azure BioSystems, Dublin, CA) bioimager.

This method can be applied to produce additional labeled or unlabeled target or dual-target sequences, whereby a dual target is defined as a target that contains two protospacer sequences targeted by individual Cascade molecules, separated by an interspacer sequence.

B. Production of dsDNA Target Sequences by PCR Amplification from gDNA dsDNA target sequences for dual targets derived from human gDNA were produced using PCR amplification directly from gDNA template material. Specifically, PCR reactions contained human gDNA purified from K562 cells and Q5 Hot Start High-Fidelity 2× Master Mix (New England Biolabs, Ipswich, MA), as well as the primers listed in Table 28, where the underlined portions correspond to primer binding sites within gDNA.

PCR was performed according to the manufacturer's instructions (New England Biolabs, Ipswich, MA), and the desired product DNA, 288 bp in length, was purified using a Nucleospin Gel and PCR Cleanup kit (Macherey-Nagel, Bethlehem, PA) This dsDNA was then used directly in DNA binding and/or DNA cleavage assays with Cascade and/or Cascade-effector domain fusion RNPs.

C. Production of dsDNA Target Sequences by Cloning Target Sequences into Bacterial Plasmids DNA oligonucleotides encoding the target region of interest comprising the target sequence, also known as the protospacer, that is recognized by the guide portion of CRISPR RNA, the neighboring protospacer adjacent motif (PAM), and additional 5' and 3' flanking sequences were purchased from a commercial manufacturer (Integrated DNA Technologies, Coralville, IA). The oligonucleotides were designed such that, when annealed, the termini regenerate sticky ends upon cleavage of their respective recognition sites by the restriction enzymes EcoRI and BlpI, or by BamHI and EcoRI. Oligonucleotides were designed to contain a single target sequence derived from the bacteriophage lambda genome, denoted J3. In addition, oligonucleotides were designed to contain two tandem target sequences derived from the bacteriophage lambda genome, denoted J3 and L3, separated from each other by a 15 bp interspacer sequence. Sequences of these oligonucleotides are listed in Table 29.

TABLE 28

Primers for PCR Amplification

| Seq ID NO: | Description | Sequence |
|---|---|---|
| SEQ ID NO: 475 | Forward primer to amplify Hsa07 dual-target from human gDNA | CACTCTTTCCCTACACGACGCTCTTCCGATCTTTCCTCCCTAACCTCCACCT |
| SEQ ID NO: 476 | Reverse primer to amplify Hsa07 dual-target from human gDNA | GGAGTTCAGACGTGTGCTCTTCCGATCTTAAAGAGCCCAACCAGATGC |

TABLE 29

Oligonucleotides Comprising Target Sequences

| SEQ ID NO: | Description | Restriction enzyme recognition sites | Sequence |
|---|---|---|---|
| SEQ ID NO: 477 | Forward oligonucleotide, J3 target sequence for cloning into PACYC-Duet1 | BamHI and EcoRI | GATCCATGCCAGTGATAAGTG GAATGCCATGTGGGCTGTCAA AAG |
| SEQ ID NO: 478 | Reverse oligonucleotide, J3 target sequence for cloning into pACYC-Duet1 | BamHI and EcoRI | AATTCTTTTGACAGCCCACATG GCATTCCACTTATCACTGGCAT G |
| SEQ ID NO: 479 | Forward oligonucleotide, J3-15 bp-L3 target sequences for cloning into PACYC-Duet1 | EcoRI and BlpI | AATTCTTTTGACAGCCCACATG GCATTCCACTTATCACTGGCAT CCTAGGCCTCTCGAGATGAGTG GCAGATATAGCCTGGTGGTTCA GGCGGCGCATGC |
| SEQ ID NO: 480 | Reverse oligonucleotide, J3-15 bp-L3 target sequences for cloning into pACYC-Duet1 | EcoRI and BlpI | TCAGCATGCGCCGCCTGAACCA CCAGGCTATATCTGCCACTCAT CTCGAGAGGCCTAGGATGCCA GTGATAAGTGGAATGCCATGT GGGCTGTCAAAAG |

The oligonucleotides contain 5'-phosphorylated ends, which were introduced by the commercial manufacturer or phosphorylated in-house using T4 polynucleotide kinase (New England Biolabs, Ipswich, MA). The oligonucleotides were then annealed at a final concentration of 1 µM by mixing together equimolar amounts in annealing buffer (6 mM HEPES, pH 7.0, 60 mM KCl), heating to 95° C. for 2 minutes, and then slow-cooling on the benchtop.

Separately, a pACYC-Duet1 (MilliporeSigma, Hayward, CA) plasmid was double-digested with the corresponding pair of restriction enzymes, either BamHI and EcoRI, or EcoRI and BlpI, whose sticky ends match the sticky ends formed by the termini of the hybridized oligonucleotides. The double-digested vector was separated from the removed insert using agarose gel electrophoresis.

In order to clone the hybridized oligonucleotides into the double-digested vector, the hybridized oligonucleotides were diluted to a 50 nM stock concentration, and then a 10 µL ligation reaction was formed using hybridized oligonucleotides, the double-digested vector, and Quick Ligase (New England Biolabs, Ipswich, MA). The ligation reaction was then used to transform chemically competent E. coli strains, and after overnight growth on agarose plates, individual clones were isolated and grown in liquid culture to generate sufficient bacterial cultures from which to isolate plasmids. Sanger sequencing was then used to validate the desired plasmid sequence. Table 30 provides complete vector sequences for plasmids containing the J3 target sequence (SEQ ID NO:481) and plasmids containing the J3 and L3 targets sequences separated by the 15 bp interspacer sequence (SEQ ID NO:482).

TABLE 30

Complete Plasmid Sequences

| SEQ ID NO: | Description of plasmid |
|---|---|
| SEQ ID NO: 481 | J3 target sequence in pACYC-Duet1 |
| SEQ ID NO: 482 | J3-15 bp-L3 target sequences in pACYC-Duet1 |
| SEQ ID NO: 483 | J3-30 bp-L3 target sequences in pACYC-Duet1 |
| SEQ ID NO: 484 | multi-target plasmid |

Further cloning manipulations were used to generate additional double-target plasmid constructs. The 15 bp interspacer sequence of SEQ ID NO:482 contains unique AvrII and XhoI restriction sites. Thus, introduction of additional hybridized oligonucleotides into these restriction sites expands the interspacer to longer lengths, for biochemical testing with purified Cascade and Cascade-nuclease fusion RNPs. Because the crRNA-guided FokI-Cascade fusion complex targets two adjacent DNA site, dimerization of the FokI domains from adjacent DNA-bound complexes leads to DNA cleavage within the interspacer separating the two target sites. Variable interspacer lengths were designed and tested to evaluate a given interspacer length with a given tethering geometry between the FokI nuclease domain and its fused Cascade subunit protein. The complete vector sequence for a target DNA substrate containing an expanded interspacer sequence of 30 bp is given in Table 30 as SEQ ID NO:483.

In addition, the following cloning strategy provided a plasmid substrate that contains several target sequences serially connected along one large insert. A gene block was ordered from a commercial manufacturer (Integrated DNA Technologies, Coralville, IA) that contained 17 consecutive dual targets. The gene block contained 4 bp separating each dual target from a neighboring dual target, and contained 16 dual targets derived from H. sapiens gDNA, as well as one control dual target containing J3/L3 targets derived from the bacteriophage lambda genome. The genomic coordinates of the 16 consecutive human dual targets are shown in Table 31. The gene block was ordered with flanking SacI and SbfI restriction sites on the ends, such that it could be cloned into SacI and SbfI sites in the pACYC-Duet1 vector. The full vector sequence of the multi-target plasmid substrate generated by cloning the gene block into pACYC-Duet1 is presented as SEQ ID NO:484 in Table 30. This multi-target sequence plasmid allowed for biochemical testing of multiple different FokI-Cascade preparations harboring crRNAs targeting one of the serially connected target sites within the plasmid.

TABLE 31

Human Dual Targets

| SEQ ID NO: | Target name | Gene | 5' spacer target genomic coordinates | 3' spacer target genomic coordinates |
|---|---|---|---|---|
| SEQ ID NO: 485 | Hsa01 | PDCD1 | chr2: 241850348-241850382 | chr2: 241850408-241850442 |
| SEQ ID NO: 486 | Hsa02 | CTLA4 | chr2: 203870664-203870698 | chr2: 203870724-203870758 |
| SEQ ID NO: 487 | Hsa03 | TRAC | chr14: 22509340-22509374 | chr14: 22509405-22509439 |
| SEQ ID NO: 488 | Hsa04 | TRAC | chr14: 22509785-22509819 | chr14: 22509850-22509884 |
| SEQ ID NO: 489 | Hsa05 | TRAC | chr14: 22513932-22513966 | chr14: 22513997-22514031 |
| SEQ ID NO: 490 | Hsa06 | TRAC | chr14: 22515993-22516027 | chr14: 22516058-22516092 |
| SEQ ID NO: 491 | Hsa07 | TRAC | chr14: 22516265-22516299 | chr14: 22516330-22516364 |
| SEQ ID NO: 492 | Hsa08 | CD52 | chr1: 26320402-26320436 | chr1: 26320467-26320501 |
| SEQ ID NO: 493 | Hsa09 | CTLA4 | chr2: 203873012-203873046 | chr2: 203873077-203873111 |
| SEQ ID NO: 494 | Hsa10 | CTLA4 | chr2: 203873195-203873229 | chr2: 203873260-203873294 |
| SEQ ID NO: 495 | Hsa11 | TRAC | chr14: 22551630-22551664 | chr14: 22551700-22551734 |
| SEQ ID NO: 496 | Hsa12 | CTLA4 | chr2: 203872758-203872792 | chr2: 203872828-203872862 |
| SEQ ID NO: 497 | Hsa13 | TRAC | chr14: 22551862-22551896 | chr14: 22551937-22551971 |
| SEQ ID NO: 498 | Hsa14 | TRBC2 | chr7:142801112-142801146 | chr7:142801187-142801221 |
| SEQ ID NO: 499 | Hsa15 | TRAC | chr14: 22551630-22551664 | chr14: 22551710-22551744 |
| SEQ ID NO: 500 | Hsa16 | CTLA4 | chr2: 203867814-203867848 | chr2: 203867894-203867928 |

Example 7

Use of Purified Cascade Complexes in Biochemical Cleavage Assays

This Example illustrates the use of FokI-Cascade fusion protein complexes in biochemical dsDNA cleavage assays. Protein reagents were compared in terms of their activity in dsDNA cleavage.

FokI-Cascade RNPs derived from the E. coli Type I-E Cascade system were designed, recombinantly expressed in E. coli, and purified for use, as outlined in Examples 1, 2, and 5. These RNPs were designed to contain either CRISPR RNAs that target the J3 and L3 target sequences derived from bacteriophage lambda gDNA, or that target an intron in the TRAC gene within human gDNA. Each RNP preparation is a heterogeneous mixture comprising two FokI-Cascade complexes that are otherwise identical except for the guide portion of the crRNA.

FokI-Cas8 was purified separately from the Cas8-less Cascade complex, programmed with guide polynucleotides targeted to the J3 and L3 lambda target sequences, and used in biochemical cleavage assays with J3/L3 plasmid substrates harboring the target sites in a PAM-in configuration.

A FokI-Cascade complex was reconstituted by mixing together a CasBCDE complex (produced using SEQ ID NO:440 and SEQ ID NO:446, as described in Example 2) with purified FokI-Cas8 comprising a 16-aa linker (the general FokI-Cas8 expression vector sequence is described in Example 2, SEQ ID NO:439 in Table 19; the particular 16-aa linker is in Example 1, SEQ ID NO:431 in Table 17). Reconstitution was performed in 1× Cascade Cleavage Buffer (20 mM Tris-Cl, pH 7.5, 200 mM NaCl, 5 mM MgCl$_2$, 1 mM TCEP, 5% glycerol) with CasBCDE and FokI-Cas8 both at 1 µM final concentrations.

In order to perform DNA cleavage assays, reaction mixtures were as follows. A plasmid substrate comprising the J3/L3 double-target sequence with a 30 bp interspacer (SEQ ID NO:483 in Table 30) was incubated with varying concentrations of FokI-Cascade complex (3-100 nM) in a 15 µL reaction in 1× Cascade Cleavage Buffer, with the plasmid DNA at a final concentration of 13.3 ng/µL. Reactions were incubated for 30 minutes at 37° C., after which 3 µL of 6×SDS loading dye was added. The loading dye was added to denature bound FokI-Cascade complexes. The reaction mixture components were resolved by 0.8% agarose gel electrophoresis. Gels were stained after electrophoresis with SYBR™ Safe DNA Gel Stain (Thermo Scientific, Wilmington, DE).

As a positive control, S. pyogenes Cas9 protein was programmed with a single-guide RNA (sgRNA) targeting a 20 bp portion of the Cascade J3 target sequence (sgRNA-J3; the spacer sequence is presented as SEQ ID NO:501). Cas9/sgRNA-J3 complexes were reconstituted by mixing Cas9 together with a 2-fold molar excess of sgRNA in 1×CCE buffer (20 mM HEPES pH 7.4, 10 mM MgCl2, 150 mM KCl, 5% glycerol). Cleavage by this Cas9/sgRNA-J3 complex was evaluated across the same concentration range (3-100 nM) by incubating reactions for 30 minutes at 37° C. Also included in the experiment were control lanes containing uncut plasmid DNA, as well as plasmid DNA linearized with the NheI restriction enzyme (New England Biolabs, Ipswich, MA). Target DNA cleavage is evidenced by a mobility shift in the plasmid, because uncut plasmid DNA is supercoiled and has a faster mobility than cleaved, linearized plasmid DNA. Nicked, open-circular plasmid DNA has a slower mobility than both supercoiled and linearized plasmid DNA.

The data obtained from these experiments demonstrate that, over the concentration range, the FokI-Cascade complex exhibited similar target DNA cleavage activity as Cas9-sgRNA. At the highest concentration tested (100 nM), the plasmid target was quantitatively linearized by the FokI-Cascade complex and Cas9-sgRNA.

FokI-Cascade complex reagents were also tested for their kinetics of target DNA cleavage. A plasmid substrate containing the J3/L3 double-target sequence with a 30 bp interspacer (SEQ ID NO:483) was incubated with 200 nM FokI-Cascade complex or 200 nM Cas9-sgRNA in a 15 µL reaction, with the plasmid DNA at a final concentration of 13.3 ng/µL. Reactions were quenched at either 0, 7, 10, 15, 20, 25, or 30 minutes, and reaction components were resolved by agarose gel electrophoresis as described above. The FokI-Cascade complex exhibited similar but slightly slower rates of target DNA cleavage activity as Cas9/sgRNA-J3 complex, with the target plasmid quantitatively linearized by the 25 minute time-point for the FokI-Cascade complex and by the 20 minute time point for the Cas9/sgRNA-J3 complex.

FokI-Cascade complex reagents were also tested for their non-specific DNA cleavage and/or nicking activity on the pACYC-Duet1 non-target plasmid substrate, versus specific DNA cleavage of a the J3/L3 double-target plasmid substrate. Table 32 contains the sequence of the pACYC-Duet1 non-target plasmid substrate used for this control (SEQ ID NO:502). Specifically, the dependence of non-specific and specific DNA target cleavage was investigated as a function of the monovalent salt concentration in the reaction buffer. Variants of the 1× Cascade Cleavage Buffer (20 mM Tris-Cl, pH 7.5, 200 mM NaCl, 5 mM MgCl$_2$, 1 mM TCEP, and 5% glycerol) were prepared, in which the NaCl concentration was dropped from 200 mM to either 150 mM, 100 mM or 50 mM, and the same cleavage reactions as described above were performed by incubating 200 nM FokI-Cascade complex with either 13.3 ng/µL of the J3/L3 target plasmid or 13.3 ng/µL of the pACYC-Duet1 non-target plasmid. Additional control reactions were performed, in which the NaCl concentration was maintained at 100 mM, but the 5 mM MgCl2 was replaced with 10 mM EDTA, which was expected to abrogate cleavage because of the requirement of FokI for divalent metal ions for DNA cleavage. Accordingly, non-target plasmid and J3/L3 target plasmid were subjected to the following reaction conditions: –FokI-Cascade complex; +FokI-Cascade complex, 100 mM NaCl buffer+10 mM EDTA; +FokI-Cascade complex, 50 mM NaCl buffer; +FokI-Cascade complex, 100 mM NaCl buffer; +FokI-Cascade complex, 150 mM NaCl buffer; +FokI-Cascade complex, 200 mM NaCl buffer. The data demonstrate that FokI-Cascade complex showed non-specific nicking of both the non-target and J3/L3 target plasmid at low salt concentrations<200 mM NaCl, but that at a monovalent salt concentration of 200 mM NaCl, the non-target plasmid remained intact, but the J3/L3 target plasmid was quantitatively linearized. Furthermore, buffer containing EDTA led to a complete abrogation of target cleavage, as expected.

In order to confirm that the FokI-Cascade complex cleaves the target plasmid at the expected position, that is, within the middle of the interspacer sequence separating the J3 and L3 targets, an experiment was performed in which the target plasmid was first incubated with FokI-Cascade complex, followed by incubation with the AfeI restriction enzyme (New England Biolabs, Ipswich, MA), which cleaves elsewhere in the plasmid substrate. Thus, cleavage by both FokI-Cascade 1 complex and AfeI converts the supercoiled, circular plasmid into two linear fragments migrating as distinct species on an agarose gel. Specifically, cleavage was expected to generate fragments that are 2427 bp and 1357 bp in length.

13.3 ng/µL J3/L3 target plasmid was incubated with 200 nM FokI-Cascade 1 complex for 30 minutes, after which 1 µL of AfeI (10 Units/µL; New England Biolabs, Ipswich, MA) was added to the reaction, followed by an additional 30-minute incubation at 37° C. Reaction products were resolved by agarose gel electrophoresis, as described above.

Additionally, for control experiments, the target plasmid was incubated with only FokI-Cascade 1 complex or only AfeI, and the same reactions were performed with a non-target plasmid that can be cleaved by AfeI but not by FokI-Cascade 1 complex (because the plasmid lacks the J3/L3 dual target). Table 32 contains the sequence of the pACYC-Duet1 non-target plasmid substrate used for this control (SEQ ID NO:502). Accordingly, non-target plasmid and J3/L3 target plasmid were subjected to the following reaction conditions: –AfeI/–FokI-Cascade complex; –AfeI/+FokI-Cascade complex; +AfeI/+FokI-Cascade complex; and +AfeI/–FokI-Cascade complex. The data demonstrate that FokI-Cascade complex cleaved the target plasmid in the expected location, because co-incubation with FokI-Cascade 1 complex and AfeI lead to two linear products of the expected lengths.

In order to further confirm the sequence specificity of DNA cleavage by the FokI-Cascade complex, additional control plasmid substrates were generated that contain as follows: mutations in the PAM flanking the J3 target, mutations in the PAM flanking the L3 target, mutations in both PAMs flanking J3/L3 targets; mutations in the spacer sequence within the J3 target, mutations in the spacer sequence within the L3 target, mutations in both spacer sequences within J3/L3 targets; and the J3 target but not the L3 target, the L3 target but not the J3 target, and neither J3 nor L3 target. Accordingly, the plasmid substrates were as follows: J3 PAM mutant, L3 PAM mutant, J3/L3 PAM mutant, J3 spacer mutant, L3 spacer mutant, J3/L3 spacer mutant, non-target plasmid, J3-only target, L3-only target, and J3/L3 target plasmid. Each target was subjected to the following reaction conditions: –NdeI/–FokI-Cascade complex; +NdeI/–FokI-Cascade complex; and –NdeI/+FokI-Cascade 1 complex. Table 32 contains the sequences of all the mutated plasmid substrates described above (SEQ ID NO:502 through SEQ ID NO:510).

TABLE 32

| Mutated Plasmid Substrate Sequences | |
|---|---|
| SEQ ID NO: | Description of plasmid |
| SEQ ID NO: 502 | pACYC-Duet1 non-target plasmid |
| SEQ ID NO: 503 | J3-30 bp-L3 target plasmid, J3 PAM mutant |
| SEQ ID NO: 504 | J3-30 bp-L3 target plasmid, L3 PAM mutant |
| SEQ ID NO: 505 | J3-30 bp-L3 target plasmid, J3/L3 PAM mutants |
| SEQ ID NO: 506 | J3-30 bp-L3 target plasmid, J3 spacer mutant |
| SEQ ID NO: 507 | J3-30 bp-L3 target plasmid, L3 spacer mutant |
| SEQ ID NO: 508 | J3-30 bp-L3 target plasmid, J3/L3 spacer mutants |
| SEQ ID NO: 509 | J3-only target plasmid |
| SEQ ID NO: 510 | L3-only target plasmid |

DNA cleavage reactions were performed as described above, using 200 nM FokI-Cascade complex and 13.3 ng/µL plasmid substrates; control reactions to linearize each plasmid substrate were performed with NdeI (New England Biolabs, Ipswich, MA). Agarose gel electrophoresis was performed as described above. The data demonstrate that efficient double-strand beak introduction and linearization of the target plasmid is only observed for the J3/L3 target plasmids, but not for control plasmids harboring PAM or seed mutations, or only one of the two target sites.

Components for various FokI-Cascade complexes were cloned and overexpressed. RNPs produced by these components were purified and tested for biochemical DNA cleavage, in order to compare activity for different FokI-Cascade complexes. Specifically, DNA cleavage activities were compared for reconstituted FokI-Cascade complexes comprising the following: separately purified CasBCDE complex (produced using SEQ ID NO:440 and SEQ ID NO:446) and FokI-Cas8 (produced using SEQ ID NO:439); FokI-Cascade harboring the J3/L3 guide crRNAs (produced using SEQ ID NO:442 and SEQ ID NO:446); FokI-Cascade harboring an additional nuclear localization signal on either the Cas7 subunit (produced using SEQ ID NO:443 and SEQ ID NO:446) or the Cas6 subunit; FokI-Cascade harboring an additional nuclear localization signal and HA tag on either the Cas7 subunit or the Cas6 subunit; FokI-Cascade that underwent a more stringent purification involving both size exclusion chromatography (SEC) and ion exchange chromatography (IEX); and FokI-Cascade that was purified only by immobilized metal affinity chromatography (IMAC), without further clean-up.

Accordingly, non-target plasmid and J3/L3 target plasmid were subjected to the following reaction conditions: negative control; AfeI; CasBCDE+FokI-Cas8 complex; FokI-Cascade complex; FokI-Cascade (NLS-Cas6) complex; FokI-Cascade (Cas7-NLS) complex; FokI-Cascade (NLS-HA-Cas6) complex; FokI-Cascade (Cas7-HA-NLS) complex; FokI-Cascade complex (IEX, SEC clean-up); and FokI-Cascade complex (no clean-up). DNA cleavage reactions were performed with these RNP reagents as described above, using either the non-target plasmid or the consensus J3/L3 target plasmids, and reaction products were resolved by agarose gel electrophoresis. The data demonstrate that all of the RNP reagents, with one exception, exhibit nearly identical and quantitative plasmid DNA cleavage, with no background cleavage of the non-target plasmid. The sole exception was the FokI-Cascade purified without further clean-up, which exhibited more non-specific nicking activity, as seen for the lane in which it was incubated with the non-target plasmid.

Finally, using the NLS-tagged Cas7 variant of the FokI-Cascade complex as a starting point, 16 different paired guide crRNA were tested for biochemical DNA cleavage of a plasmid substrate for *H. sapiens* genomic sites Hsa01 through Hsa16 serially connected along one large insert (SEQ ID NO:484). Each pair of crRNAs contains two unique spacer sequences that correspond to two adjacent target sites in human gDNA, separated by an interspacer; the target sequences are described in SEQ ID NO:485 through SEQ ID NO:500. Table 33 contains sequences of both crRNAs within each pair that targets Hsa01 through Hsa16 gDNA sequences; the spacer of the crRNA is underlined and in lower case, and the sequences 5' and 3' of the guide region correspond to repeat sequences from the CRISPR array.

TABLE 33 crRNA Sequences

| SEQ ID NO: | DNA target | crRNA sequence |
|---|---|---|
| SEQ ID NO: 511 | Hsa01-1 | AUAAACCGcgggcaggcagagcuggaggccuuucaggccc GAGUUCCCCGCGCCAGCGGGG |
| SEQ ID NO: 512 | Hsa01-2 | AUAAACCGggccugaggugcugccugggcauguguaaagg GAGUUCCCCGCGCCAGCGGGG |
| SEQ ID NO: 513 | Hsa02-1 | AUAAACCGcacugucacccggaccucaguggcuuugccug GAGUUCCCCGCGCCAGCGGGG |
| SEQ ID NO: 514 | Hsa02-2 | AUAAACCGucugugcagcaaccuacaugauggggaaugag GAGUUCCCCGCGCCAGCGGGG |
| SEQ ID NO: 515 | Hsa03-1 | AUAAACCGaugagcuuguuuguagcaccaccauaauucac GAGUUCCCCGCGCCAGCGGGG |
| SEQ ID NO: 516 | Hsa03-2 | AUAAACCGuacguaaguaguggcaugugucagguggauuc GAGUUCCCCGCGCCAGCGGGG |
| SEQ ID NO: 517 | Hsa04-1 | AUAAACCGaaggcauuuggaccggcagacacauaauugua GAGUUCCCCGCGCCAGCGGGG |
| SEQ ID NO: 518 | Hsa04-2 | AUAAACCGagacuccagagccauccuugggaagagugcug GAGUUCCCCGCGCCAGCGGGG |
| SEQ ID NO: 519 | Hsa05-1 | AUAAACCGacaagaggguguguuuccugaauucccacagug GAGUUCCCCGCGCCAGCGGGG |
| SEQ ID NO: 520 | Hsa05-2 | AUAAACCGuaaguguuucuagccauccuugauuugauca GAGUUCCCCGCGCCAGCGGGG |
| SEQ ID NO: 521 | Hsa06-1 | AUAAACCGuggcuacugcucugucuccugggauccugccu GAGUUCCCCGCGCCAGCGGGG |
| SEQ ID NO: 522 | Hsa06-2 | AUAAACCGgcccauaccuucaaggaaaauuaaggcaaauaG AGUUCCCCGCGCCAGCGGGG |
| SEQ ID NO: 523 | Hsa07-1 | AUAAACCGguugauuugccugcauuggguguuacacagucu GAGUUCCCCGCGCCAGCGGGG |

TABLE 33-continued crRNA Sequences

| SEQ ID NO: | DNA target | crRNA sequence |
|---|---|---|
| SEQ ID NO: 524 | Hsa07-2 | AUAAACCGuaaguuguguucuucuuugccuaggccuucagGAGUUCCCCGCGCCAGCGGGG |
| SEQ ID NO: 525 | Hsa08-1 | AUAAACCGgcacugccugucaacuucuacaaccuggugauGAGUUCCCCGCGCCAGCGGGG |
| SEQ ID NO: 526 | Hsa08-2 | AUAAACCGuaggggccaagcagugcccagcuggggucaaGAGUUCCCCGCGCCAGCGGGG |
| SEQ ID NO: 527 | Hsa09-1 | AUAAACCGcuuucacugaaaguggagcugaugugacagaaGAGUUCCCCGCGCCAGCGGGG |
| SEQ ID NO: 528 | Hsa09-2 | AUAAACCGauguggucaaggaauuaaguuagggaauggcGAGUUCCCCGCGCCAGCGGGG |
| SEQ ID NO: 529 | Hsa10-1 | AUAAACCGgcauaaaauuuaacuugaaaagaucauuucggGAGUUCCCCGCGCCAGCGGGG |
| SEQ ID NO: 530 | Hsa10-2 | AUAAACCGgcuucaaaaauacucacauggcuauguuuuagGAGUUCCCCGCGCCAGCGGGG |
| SEQ ID NO: 531 | Hsa11-1 | AUAAACCGaggggcaaugcagaggaaggagcgagggagcaGAGUUCCCCGCGCCAGCGGGG |
| SEQ ID NO: 532 | Hsa11-2 | AUAAACCGgaggugaaagcugcuaccaccucugugccccGAGUUCCCCGCGCCAGCGGGG |
| SEQ ID NO: 533 | Hsa12-1 | AUAAACCGgcugaaauugcuuuucacauucggcucuguuGAGUUCCCCGCGCCAGCGGGG |
| SEQ ID NO: 534 | Hsa12-2 | AUAAACCGagaguccauauuucaauuccaagagcugaggGAGUUCCCCGCGCCAGCGGGG |
| SEQ ID NO: 535 | Hsa13-1 | AUAAACCGugcacagccaggggaggcugcagcagccuugcGAGUUCCCCGCGCCAGCGGGG |
| SEQ ID NO: 536 | Hsa13-2 | AUAAACCGauggaucuucaguggguucucuugggcucuagGAGUUCCCCGCGCCAGCGGGG |
| SEQ ID NO: 537 | Hsa14-1 | AUAAACCGccuguggccaggcacaccagugUGGCCUUUUGGAGUUCCCCGCGCCAGCGGGG |
| SEQ ID NO: 538 | Hsa14-2 | AUAAACCGgaggugcacaguggggucagcacagacccgcaGAGUUCCCCGCGCCAGCGGGG |
| SEQ ID NO: 539 | Hsa15-1 | AUAAACCGaggggcaaugcagaggaaggagcgagggagcaGAGUUCCCCGCGCCAGCGGGG |
| SEQ ID NO: 540 | Hsa15-2 | AUAAACCGcugcuaccaccucugugcccccccggcaaugcGAGUUCCCCGCGCCAGCGGGG |
| SEQ ID NO: 541 | Hsa16-1 | AUAAACCGgacuuuauauagauagcuuugaucccagauauGAGUUCCCCGCGCCAGCGGGG |
| SEQ ID NO: 542 | Hsa16-2 | AUAAACCGguuuugcucuacuuccugaagaccugaacaccGAGUUCCCCGCGCCAGCGGGG |

After the 16 FokI-Cascade complexes were purified, cleavage reactions were performed as described above, wherein the FokI-Cascade complexes were incubated with the plasmid substrate containing *H. sapiens* genomic sites Hsa01 through Hsa16, and the reaction products were resolved by agarose gel electrophoresis. The data demonstrate that, of the 16 RNP reagents, 14/16 (Hsa03-Hsa16) exhibited nearly quantitative DNA cleavage, as evidenced by conversion of the supercoiled, circular plasmid substrate into the cleaved, linear form. Only constructs Hsa01 and Hsa02 showed partial nicking activity. Furthermore, the data demonstrated that the FokI-Cascade complexes were effectively programmed using the designed 16 paired gRNAs to target therapeutically relevant *H. sapiens* genes.

Example 8

Introduction of FokI-Cascade RNP Complexes into Target Cells

This Example illustrates the design and delivery of *E. coli* Type I-E Cascade complexes comprising FokI fusion proteins to facilitate genome editing in human cells and describes their delivery into target cells as pre-assembled Cascade RNP complexes.

A. Production of Cascade RNP Complexes Comprising FokI for Transformation into Cells Minimal CRISPR arrays were designed to target eight distinct loci in the human genome. Each minimal CRISPR array contained two spacer sequences, both of which were flanked by CRISPR repeat sequences. The two spacer sequences targeted loci in the genome separated by 30 bp (i.e., a 30 bp interspacer region), and each spacer was designed to bind a target sequence adjacent to an AAG or ATG protospacer adjacent motif (PAM) sequence in the target cell genome. Plasmid vectors containing each minimal CRISPR array were produced by ligating annealed oligonucleotides (Integrated DNA Technologies, Coralville, IA) into a pACYC-Duet1 (MilliporeSigma, Hayward, CA) vector backbone for bacterial expression.

Overlapping primers to produce selected spacers in minimal CRISPR arrays are set forth in Table 34, and the sequences of the primers are described in Table 35.

TABLE 34

Overlapping Primers for Generation of Minimal CRISPR arrays

| Component | Gene target | Primers |
|---|---|---|
| Hsa03 Minimal CRISPR array | TRAC intron | A, B |
| Hsa04 Minimal CRISPR array | TRAC intron | C, D |
| Hsa05 Minimal CRISPR array | TRAC intron | E, F |
| Hsa06 Minimal CRISPR array | TRAC intron | G, H |
| Hsa07 Minimal CRISPR array | TRAC intron | I, J |
| Hsa08 Minimal CRISPR array | CD52 exon | K, L |
| Hsa09 Minimal CRISPR array | CTLA4 exon | M, N |
| Hsa10 Minimal CRISPR array | CTLA4 exon | O, P |

TABLE 35

DNA Primer Sequences

| SEQ ID NO: | Oligo-nucleotide | Sequence |
|---|---|---|
| SEQ ID NO: 543 | A | /5Phos/ACCGATGAGCTTGTTTGTAGCACCACCATAATTC ACGAGTTCCCCGCGCCAGCGGGGATAAACCGTACGTA AGTAGTGGCATGTGTCAGGTGGATTC |
| SEQ ID NO: 544 | B | /5Phos/ACTCGAATCCACCTGACACATGCCACTACTTACG TACGGTTTATCCCCGCTGGCGCGGGGAACTCGTGAATT ATGGTGGTGCTACAAACAAGCTCAT |
| SEQ ID NO: 545 | C | /5Phos/ACCGAAGGCATTTGGACCGGCAGACACATAATT GTAGAGTTCCCCGCGCCAGCGGGGATAAACCGAGACT CCAGAGCCATCCTTGGGAAGAGTGCTG |
| SEQ ID NO: 546 | D | /5Phos/ACTCCAGCACTCTTCCCAAGGATGGCTCTGGAGT CTCGGTTTATCCCCGCTGGCGCGGGGAACTCTACAATT ATGTGTCTGCCGGTCCAAATGCCTT |
| SEQ ID NO: 547 | E | /5Phos/ACCGACAAGAGGTGTGTTTCCTGAATTCCCACA GTGGAGTTCCCCGCGCCAGCGGGGATAAACCGTAAGT GTTTCTAGCCATCCTTGATTTTGATCA |
| SEQ ID NO: 548 | F | /5Phos/ACTCTGATCAAAATCAAGGATGGCTAGAAACAC TTACGGTTTATCCCCGCTGGCGCGGGGAACTCCACTGT GGGAATTCAGGAAACACACCTCTTGT |
| SEQ ID NO: 549 | G | /5Phos/ACCGTGGCTACTGCTCTGTCTCCTGGGATCCTGC CTGAGTTCCCCGCGCCAGCGGGGATAAACCGGCCCAT ACCTTCAAGGAAAATTAAGGCAAATA |
| SEQ ID NO: 550 | H | /5Phos/ACTCTATTTGCCTTAATTTTCCTTGAAGGTATGG GCCGGTTTATCCCCGCTGGCGCGGGGAACTCAGGCAG GATCCCAGGAGACAGAGCAGTAGCCA |
| SEQ ID NO: 551 | I | /5Phos/ACCGGTTGATTTGCCTGCATTGGTGTTACACAGT CTGAGTTCCCCGCGCCAGCGGGGATAAACCGTAAGTTG TGTTCTTCTTTGCCTAGGCCTTCAG |
| SEQ ID NO: 552 | J | /5Phos/ACTCCTGAAGGCCTAGGCAAAGAAGAACACAAC TTACGGTTTATCCCCGCTGGCGCGGGGAACTCAGACTG TGTAACACCAATGCAGGCAAATCAAC |
| SEQ ID NO: 553 | K | /5Phos/ACCGGCACTGCCTGTCAACTTCTACAACCTGGTG ATGAGTTCCCCGCGCCAGCGGGGATAAACCGTAGGGG CCAAGCAGTGCCCAGCTGGGGGTCAA |
| SEQ ID NO: 554 | L | /5Phos/ACTCTTGACCCCCAGCTGGGCACTGCTTGGCCCC TACGGTTTATCCCCGCTGGCGCGGGGAACTCATCACCA GGTTGTAGAAGTTGACAGGCAGTGC |
| SEQ ID NO: 555 | M | /5Phos/ACCGCTTTCACTGAAAGTGGAGCTGATGTGACA GAAGAGTTCCCCGCGCCAGCGGGGATAAACCGATGTG GGTCAAGGAATTAAGTTAGGGAATGGC |
| SEQ ID NO: 556 | N | /5Phos/ACTCGCCATTCCCTAACTTAATTCCTTGACCCAC ATCGGTTTATCCCCGCTGGCGCGGGGAACTCTTCTGTC ACATCAGCTCCACTTTCAGTGAAAG |

TABLE 35-continued

DNA Primer Sequences

| SEQ ID NO: | Oligo-nucleotide | Sequence |
|---|---|---|
| SEQ ID NO: 557 | O | /5Phos/ACCGGCATAAAATTTAACTTGAAAAGATCATTTCGGGAGTTCCCCGCGCCAGCGGGGATAAACCGGCTTCAAAAATACTCACATGGCTATGTTTTAG |
| SEQ ID NO: 558 | P | /5Phos/ACTCCTAAAACATAGCCATGTGAGTATTTTTGAAGCCGGTTTATCCCCGCTGGCGCGGGGAACTCCCGAAATGATCTTTTCAAGTTAAATTTTATGC |
| SEQ ID NO: 559 | Q | CACTCTTTCCCTACACGACGCTCTTCCGATCTAGCCTGGAAAGACACAAAGC |
| SEQ ID NO: 560 | R | GGAGTTCAGACGTGTGCTCTTCCGATCTCAGCCATCCTTTCCACCTAA |
| SEQ ID NO: 561 | S | CACTCTTTCCCTACACGACGCTCTTCCGATCTATGCTGCAGGCTTTATGCTT |
| SEQ ID NO: 562 | T | GGAGTTCAGACGTGTGCTCTTCCGATCTTTAGGCCTGCCTGACTTCTC |
| SEQ ID NO: 563 | U | CACTCTTTCCCTACACGACGCTCTTCCGATCTGGGAAGAAGACCAACAAGAGG |
| SEQ ID NO: 564 | V | GGAGTTCAGACGTGTGCTCTTCCGATCTTTCAAGGGAAGAAGCCATTG |
| SEQ ID NO: 565 | W | CACTCTTTCCCTACACGACGCTCTTCCGATCTAAGGCAGGAATTGGATGAAA |
| SEQ ID NO: 566 | X | GGAGTTCAGACGTGTGCTCTTCCGATCTAACCTGAGATGACTGCCCAT |
| SEQ ID NO: 567 | Y | CACTCTTTCCCTACACGACGCTCTTCCGATCTTTCCTCCCTAACCTCCACCT |
| SEQ ID NO: 568 | Z | GGAGTTCAGACGTGTGCTCTTCCGATCTTAAAGAGCCCAACCAGATGC |
| SEQ ID NO: 569 | A2 | CACTCTTTCCCTACACGACGCTCTTCCGATCTGTCTCAGCCTTAGCCCTGTG |
| SEQ ID NO: 570 | B2 | GGAGTTCAGACGTGTGCTCTTCCGATCTCCCACTGCAAGTACAAGGGT |
| SEQ ID NO: 571 | C2 | CACTCTTTCCCTACACGACGCTCTTCCGATCTGGATGCGGAACCCAAATTA |
| SEQ ID NO: 572 | D2 | GGAGTTCAGACGTGTGCTCTTCCGATCTTAGTCTTCTCCCTCGCTCCC |
| SEQ ID NO: 573 | E2 | CACTCTTTCCCTACACGACGCTCTTCCGATCTTGCAGCATTATGATGTGGGT |
| SEQ ID NO: 574 | F2 | GGAGTTCAGACGTGTGCTCTTCCGATCTCAACCTTTAGCATCACTGGCT |
| SEQ ID NO: 575 | G2 | CAAGCAGAAGACGGCATACGAGANNNNNNNNGTGACTGGAGTTCAGACGTGTGCTC |
| SEQ ID NO: 576 | H2 | AATGATACGGCGACCACCGAGATCTACACNNNNNNNNNACACTCTTTCCCTACACGACG |

The design of bacterial expression vectors for production of Cascade RNP complexes is detailed in Example 2. In brief, each cas gene was expressed from a single operon, and the coding sequences for the cas genes were arranged in the order of cas8-cse2-cas7-cas5-cas6. The FokI moiety was attached by a 30-aa linker to Cas8, and a nuclear localization signal (NLS) was attached to the N-terminus of FokI-Cas8 (FokI-Cascade complex) and the N-terminus of Cas6 (hereafter referred to as FokI-Cascade-NLS-Cas6 complex, SEQ ID NO:577).

FokI-Cascade-NLS-Cas6 complexes were purified as assembled complexes from *E. coli* essentially as described in Example 5A.

B. Transfection of Cascade RNP Complexes Comprising FokI into Eukaryotic Cells

HEK293 cells (ATCC, Manassas, VA) were cultured in suspension in DMEM medium supplemented with 10% FBS and 1× Antibiotic-Antimycotic Solution (Mediatech, Inc., Manassas, VA) at 37° C., 5% $CO_2$ and 100% humidity. HEK293 cells were transfected using the Nucleofector®

96-well Shuttle System (Lonza, Allendale, NJ). Prior to nucleofection, 5 µl of FokI-Cascade RNPs were transferred to individual wells of a 96-well plate. Each well contained ~225-500 pmol of FokI-Cascade-NLS-Cas6 complexes, depending on the RNP. HEK293 cells were transferred to a 50 ml conical centrifuge tube and centrifuged at 200×G for 3 minutes. The media was aspirated and the cell pellet was washed in calcium and magnesium-free PBS. The cells were centrifuged once more and re-suspended in Nucleofector SF (Lonza, Allendale, NJ) buffer at a concentration of $1 \times 10^7$ cells/ml. 20 µl of this cell suspension was added to the FokI-Cascade-NLS-Cas6 complexes in the 96-well plate, mixed, and then the entire volume was transferred to a 96-well Nucleocuvette™ (Lonza, Allendale, NJ) plate. The plate was then loaded into the Nucleofector™ 96-well Shuttle™ System (Lonza, Allendale, NJ) and cells were nucleofected using the 96-CM-130 Nucleofector™ program (Lonza, Allendale, NJ). Immediately following nucleofection, 80 µl of complete DMEM medium was added to each well of the 96-well Nucleocuvette™ (Lonza, Allendale, NJ) plate. The entire contents of the well were then transferred to a 96-well tissue culture plate containing 100 µl of complete DMEM medium. The cells were cultured at 37° C., 5% $CO_2$ and 100% humidity for ~72 hours.

After ~72 hours, the HEK293 cells were centrifuged at 500×G for 5 minutes and the medium was removed. The cells were washed in calcium and magnesium-free PBS. The cell pellets were then re-suspended in 50 µl of QuickExtract DNA Extraction solutions (Epicentre, Madison, WI). The gDNA samples obtained were then incubated at 37° C. for 10 minutes, 65° C. for 6 minutes, and 95° C. for 3 minutes to stop the reaction. gDNA samples were then diluted with 50 µl of water and stored at −20° C. for subsequent deep sequencing analysis.

C. Deep Sequencing of gDNA from Transfected Cells

Using the isolated gDNA, a first PCR was performed using Q5 Hot Start High-Fidelity 2× Master Mix (New England Biolabs, Ipswich, MA) at 1× concentration, primers at 0.5 µM each, 3.75 µL of gDNA in a final volume of 10 µL and amplified 98° C. for 1 minutes, 35 cycles of 10 seconds at 98° C., 20 seconds at 60° C., 30 seconds at 72° C., and a final extension at 72° C. for 2 minutes. PCR reaction was diluted 1:100 in water. Target-specific primers are shown in Table 36. The target-specific primers contained Illumina-compatible sequences so that the amplification products could be analyzed using a MiSeq Sequencer (Illumina, San Diego, CA).

TABLE 36

Target-specific Primers Used for Sequencing

| Target | Oligonucleotide* |
|---|---|
| Hsa03 on-target | Q, R |
| Hsa04 on-target | S, T |
| Hsa05 on-target | U, V |
| Hsa06 on-target | W, X |
| Hsa07 on-target | Y, Z |
| Hsa08 on-target | A2, B2 |
| Hsa09 on-target | C2, D2 |
| Hsa10 on-target | E2, F2 |

*DNA primer sequences are shown in Table 35

A second "barcoding" PCR was set up such that each target was amplified with primers (G2 and H2 in Table 35) that each contained unique 8-bp indices (denoted by "NNNNNNNN" in the primer sequence (see SEQ ID NO:575 and SEQ ID NO:576), thus allowing de-multiplexing of each amplicon during sequence analysis.

The second PCR was performed using Q5 Hot Start High-Fidelity 2× Master Mix (New England Biolabs, Ipswich, MA) at 1× concentration, primers at 0.5 µM each, 1 µL of 1:100 diluted first PCR, in a final volume of 10 µL and amplified 98° C. for 1 minute, 12 cycles of 10 seconds at 98° C., 20 seconds at 60° C., 30 seconds at 72° C., and a final extension at 72° C. for 2 minutes. PCR reactions were pooled into a single microfuge tube for SPRIselect bead (Beckman Coulter, Pasadena, CA)-based cleanup of amplicons for sequencing.

To pooled amplicons, 0.9× volumes of SPRIselect beads were added, mixed and incubated at room temperature for 10 minutes. The microfuge tube was placed on a magnetic tube stand (Beckman Coulter, Pasadena, CA) until solution had cleared. Supernatant was removed and discarded, and the residual beads were washed with 1 volume of 85% ethanol, and incubated at room temperature (RT) for 30 seconds. After incubation, ethanol was aspirated and beads were air dried at room temperature for 10 minutes. The microfuge tube was then removed from the magnetic stand and 0.25× volumes of water was added to the beads, mixed vigorously, and incubated for 2 min. at RT. The microfuge tube was spun in a microcentrifuge to collect the contents of the tube, and was then returned to the magnet, incubated until solution had cleared, and the supernatant containing the purified amplicons were dispensed into a clean microfuge tube. The purified amplicon library was quantified using the Nanodrop™ 2000 (Thermo Scientific, Wilmington, DE) system.

The amplicon library was normalized to 4 nM concentration as calculated from optical absorbance at 260 nm (Nanodrop™ 2000 (Thermo Scientific, Wilmington, DE) system) and size of the amplicons. Library was analyzed on MiSeq Sequencer (Illumina, San Diego, CA) with MiSeq Reagent Kit v2, 300 cycles (Illumina, San Diego, CA), with two 151-cycle paired-end run plus two eight-cycle index reads.

D. Deep Sequencing Data Analysis

The identity of products in the sequencing data was analyzed based upon the index barcode sequences adapted onto the amplicons in the second round of PCR. A computational script executing the following tasks was used to process the MiSeq (Illumina, San Diego, CA) data:

Reads were aligned to the human genome (build GRCh38/38) using Bowtie (bowtie-bio.sourceforge.net/index.shtml) software.

Aligned reads were compared to wild-type loci; reads not aligning to any part of the loci were discarded.

Reads matching wild-type sequence were tallied. Reads with indels (surrounding 10 bp from the FokI-Cascade RNP expected cut site) were categorized by indel type and tallied.

Total indel reads were divided by the sum of wild-type reads and indel reads to give percent-mutated reads.

Figure 28:
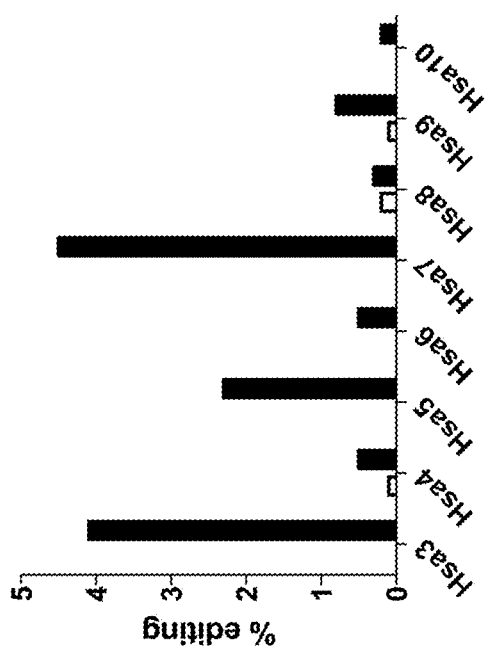

FIG. 28 shows genome editing (FIG. 28, vertical axis, "% editing") as a function of FokI-Cascade-NLS-Cas6 complex nucleofection (n=1) (FIG. 27, horizontal axis, Hsa3, Hsa4, Hsa5, Hsa6, Hsa7, Hsa8, Hsa9, and Hsa10). In FIG. 28, the open bars are the negative controls and the black bars are addition of FokI-Cascade-NLS-Cas6 complexes). FokI-Cascade-NLS-Cas6 complexes induced editing at all eight loci. Editing ranged from ~0.2-5% indels, and indels were centered around the predicted cut site, in the middle of the interspacer region.

Example 9

Introduction of Plasmids Encoding Components of FokI-Cascade RNP Complexes into Target Cells This Example illustrates the design and delivery of *E. coli* Type I-E Cascade complexes comprising FokI fusion proteins to facilitate genome editing in human cells. This Example also describes the delivery of plasmid vectors expressing Cascade complex components into eukaryotic cells.

A. Production of a Vector Encoding FokI-Cascade RNP Components to be Transfected into Target Cells A minimal CRISPR array was designed to target the TRAC locus in the human genome. The minimal CRISPR array contained two spacer sequences, both of which were flanked by CRISPR repeat sequences, as described in Examples 1 and 3. The two spacer sequences targeted loci in the genome separated by 30 bp and each spacer was complementary to a genomic sequence adjacent to an AAG PAM sequence. The plasmid vector containing the minimal CRISPR array was produced by ligating annealed oligonucleotides (Integrated DNA Technologies, Coralville, IA) encoding a CRISPR repeat flanked by two spacer sequences into a mammalian expression vector with two CRISPR repeat sequences. The resulting plasmid contained a "repeat-spacer-repeat-spacer-repeat" that expressed two guides from the human U6 (hU6) promoter (SEQ ID No:454).

FokI-Cascade RNP protein component-encoding genes were cloned into plasmid vectors containing CMV promoters to enable delivery and expression in mammalian cells. Cas genes were cloned into separate plasmids (SEQ ID NO:448 through SEQ ID NO:451 and SEQ ID NO:453) or in a single plasmid as a polycistronic construct with each gene linked via 2A viral peptide "ribosome-skipping" sequences (in SEQ ID NO:455). FokI-Cascade RNP complexes were delivered into eukaryotic cells via two different methods: cas genes and the minimal CRISPR array were supplied on separate plasmids (six-plasmid delivery system, SEQ ID NO:448 through SEQ ID NO:451, SEQ ID NO:453 and SEQ ID NO:454), or one plasmid encoding all cas genes as a polycistronic construct and a second plasmid encoding the minimal CRISPR array (two-plasmid delivery system, SEQ ID NO:454 and SEQ ID NO:455).

B. Transfection of Plasmid(s)-Encoding FokI-Cascade RNP Complexes

Transfection conditions for the six-plasmid delivery system and two-plasmid delivery systems were performed as detailed in Example 8B with the following modifications. Prior to nucleofection, 5 μl of plasmid vector solution was transferred to individual wells of a 96-well plate. The six-plasmid delivery system was initially tested by examining the necessity of each component for genome editing. More specifically, plasmid "cocktails" were added to each well such that there was a constant amount (420 ng) of five plasmids and a variable amount of the sixth plasmid (either 0 ng, 70 ng, 700 ng, or 1,400 ng). Next, the six plasmid delivery system and the two-plasmid delivery system were compared by nucleofecting in a fixed amount (3.5 μg) of total plasmid DNA while varying the ratio of minimal CRISPR array plasmid to cas-encoding plasmid(s). Finally, lysate was harvested ~72 hours after nucleofection for subsequent deep sequencing analysis.

C. Deep Sequencing of gDNA from Transfected Cells and Data Analysis

Deep sequencing was performed as detailed in Example 8C, but only using target-specific primers Y and Z from Table 36.

D. Deep Sequencing Data Analysis

Figure 29:
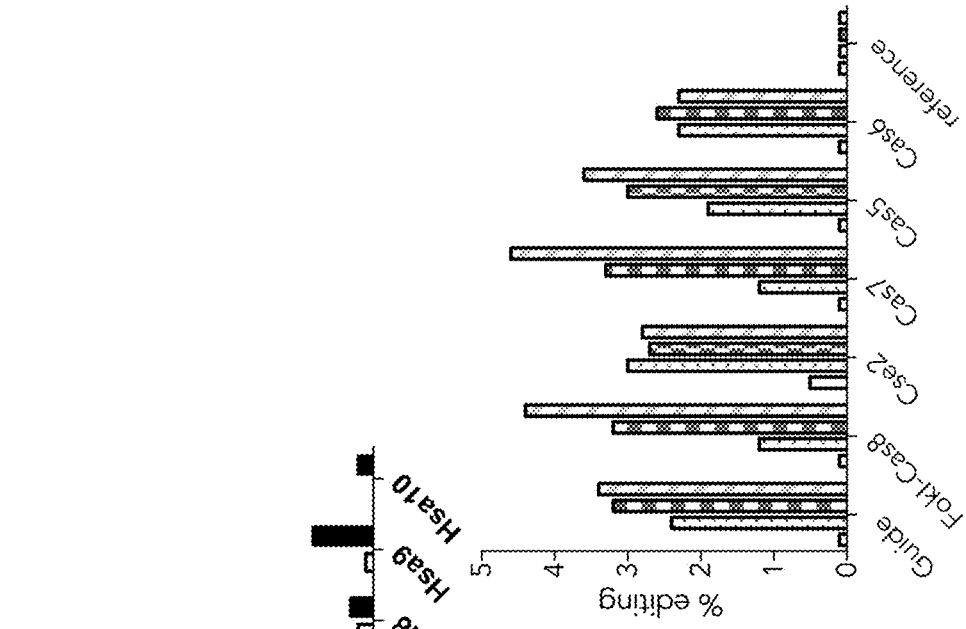

Deep sequencing data analysis was performed as detailed in Example 8D. FIG. 29 shows genome editing (FIG. 29, vertical axis, "% editing") at the TRAC locus as a function of each FokI-Cascade component in the six-plasmid delivery strategy (n=1) (FIG. 29, horizontal axis, Guide, FokI-Cas8, Cse2, Cas7, Cas5, Cas6, and reference sample). In FIG. 29, open bars represent 0 ng of the FokI-Cascade component, stippled bars represent 70 ng of the FokI-Cascade component, square pattern bars represent 700 ng of the FokI-Cascade component, and striped bars 1,400 ng of the FokI-Cascade component (bar order on the horizontal axis is left to right, respectively, for each FokI-Cascade component). As is shown, editing was abolished or dramatically reduced (in the case of Cse2) if a given component was lacking. This confirms that each Cascade component is necessary for editing via plasmid delivery.

Figure 30:
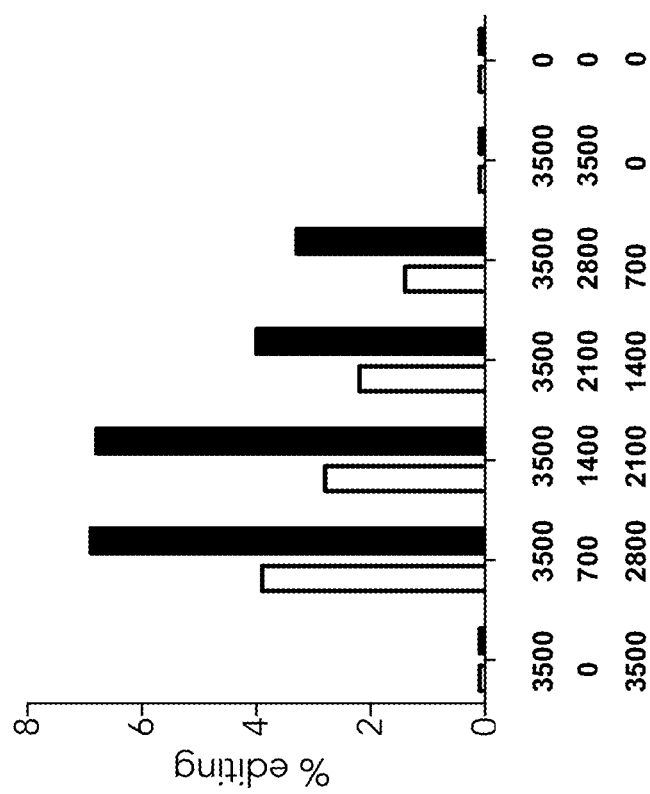

FIG. 30 shows data comparing genome editing with the six-plasmid delivery system or the two-plasmid delivery system. FIG. 30 shows genome editing (FIG. 30, vertical axis, "% editing") at the target locus as a function of varying concentrations of each component of the six-plasmid (FIG. 30, open bars) and two-plasmid (FIG. 30, black bars) systems (FIG. 30, bar order on the horizontal axis is left to right, respectively, six-plasmid system and two-plasmid system). Numerical groupings along the horizontal axis refer to amounts of components: top line=total plasmid in ng, second line=minimal CRISPR array plasmid in ng, and third line=Cas-encoding plasmids in ng (e.g., first numerical grouping: top line=total plasmid, 3500 ng; second line=minimal CRISPR array plasmid, 0 ng; and third line=Cas-encoding plasmids, 3500 ng).

Across both methods, the highest levels of editing were achieved with the highest ratio of cas:minimal CRISPR array plasmids. Additionally, the polycistronic plasmid enabled higher levels of editing, potentially due to increased transcription perm of plasmid.

Example 10

Circular Permutations of Cascade Subunit Proteins

This Example illustrates in silico design, cloning, expression, and purification of a circularly-permuted (cp) *E. coli* Type I-E Cas7 protein using a structure-guided modeling approach.

A. In Silico Design

An *E. coli* Type I-E Cas7 protein (SEQ ID NO:18) was circularly permuted using a structure-guided approach based on the *E. coli* Cascade crystal structure 5H9E.pdb (www.rcsb.org/pdb/; Hayes, R. P., et al., Nature 530(7591):499-503 (2016)). The native Cas7 N-terminus and C-terminus were connected with a two-amino acid peptide linker having the sequence glycine-serine (G-S). The polypeptide sequence of this circularized Cas7 was opened at the position corresponding to the peptide bond between residues 301 and 302 in wild-type Cas7 polypeptide sequence to form a new N-terminus (residue 302) and a new C-terminus (residue 301), resulting in a circular permuted version of Cas7 protein (cp-Cas7 V1 protein). The new N-terminus and new C-terminus were designed to be positioned for connection with a fusion protein or linker region without disturbing the Cas7 protein fold or the Cascade complex assembly. A methionine residue was added to the new N-terminus (i.e., the amino acid residue corresponding to residue 302 of the wild-type Cas7 protein) of the cp-Cas7 V1 protein (SEQ ID NO:578).

A second cp-Cas7 protein, cp-Cas7 V2 protein, was similarly engineered using the G-S linker. The N-terminus and C-terminus of the cp-Cas7 V2 protein correspond to residues 338 and 339, respectively, in the wild-type Cas7 sequence. The new N-terminus and new C-terminus were designed to be positioned for connection with a fusion protein or linker region without disturbing the Cas7 protein fold or the Cascade complex assembly. A methionine residue was added to the N-terminus (i.e., the amino acid residue corresponding to residue 339 of the wild-type Cas7 protein) of the cp-Cas7 V2 protein (SEQ ID NO:579).

B. Cloning, Expression, and Purification of Cascade Complexes Comprising cp-Cas7

DNA coding sequences of the in silico designed polypeptide sequences of cp-Cas7 V1 protein and cp-Cas7 V2 protein were codon-optimized for expression in *E. coli*.

These DNA coding sequences were provided to a commercial manufacturer (GenScript, Piscataway, NJ) for synthesis. The DNA sequences were individually introduced into a Cascade-operon expression vector (Table 19; SEQ ID NO:441) to replace the wild-type Cas7 protein in the expression vector as described in Example 2.

Each expression vector was transfected into *E. coli* BL21 Star™ (Thermo Fisher Scientific, Waltham, MA) cells with a second vector encoding a guide RNA for the J3 target (SEQ ID NO:444) set forth in Table 20, as described in Example 2. Cells were cultured as described in Example 4B. *E. coli* Type I-E Cascade complexes containing Cas5, Cas6, cp-Cas7 V1, Cse2, and Cas8 proteins, as well as guide RNA/target J3; and Cas5, Cas6, cp-Cas7 V2, Cse2, and Cas8 proteins as well as guide RNA/target J3, were purified as described in Example 5A.

Purification of the Cascade complexes comprising the cp-Cas7 variants demonstrate that circularly-permuted Type I-E CRISPR-Cas subunit proteins can be successfully used to form Cascade complexes having essentially the same composition (based on molecular weight) as Cascade complexes comprising wild-type proteins.

C. EMSA (Electrophoretic Mobility Shift Assays) of Cascade/cp-Cas7 and J3 Target Purified Cascade/cp-Cas7 complexes were purified as described in this Example and subjected to an EMSA to demonstrate specific binding to their respective target sequence. Briefly, Cascade/cp-Cas7 and Cascade/wt-Cas7 were purified and concentrated to 10 mg/mL. Cy5 double-stranded target DNA was produced essentially as described in Example 6A and diluted to 1 µM in TE buffer (J3 target SEQ ID NO:469 and SEQ ID NO:472 and CCR5 target SEQ ID NO:474 and SEQ ID NO:470). Cascade complexes and labeled double-stranded target DNA were incubated for 30 min at 37° C. at different protein/target ratios. Immediately following the incubation, 2 µl of 50% glycerol was added to the samples and they were loaded on a 5% native PAA gel. Gels were run at 4° C. at 70V for 90 min in 0.5×TBE buffer and imaged on an AZURE c600 Bioimager (Azure BioSystems, Dublin, CA) and the bands were quantitated. The data are presented in Table 37.

TABLE 37

Results of Cascade/cp-Cas7 V2 EMSA

| Cascade ID and guide | Target DNA | Cascade:dsDNA ratio | Gel shift % |
|---|---|---|---|
| Cascade/wt-Cas7 J3 | J3 | 6.7 | 44 |
| Cascade/cp-Cas7 V2 J3 | J3 | 6.7 | 90 |
| Cascade/wt-Cas7 J3 | CCR5 | 6.7 | LOD* |
| Cascade/cp-Cas7 V2 J3 | CCR5 | 6.7 | LOD |

*LOD = below the limit of detection

Example 11

Cascade Subunit Fusion Proteins

A. Cascade Subunit Fusion with FokI

This Example illustrates in silico design, cloning, expression, and purification of a *E. coli* Type I-E Cas8 protein fused to a FokI nuclease domain to confer nuclease activity to the Cascade complex.

*E. coli* Type I-E Cas8 was fused N-terminally with a *Flavobacterium okeanokoites* FokI nuclease domain (GenBank no. AAA24927.1). The FokI nuclease domain comprises residues contained in the Sharkey variant described by Guo, et al. (Guo, J., et al., J. Mol. Biol. 400:96-107 (2010)), and catalyzes double-stranded DNA cleavage upon homodimerization. The amino acid sequence for the FokI nuclease (SEQ ID NO:580) contained residues Q384 to F579 (GenBank no. AAA24927.1) and had the following point mutations: E486Q, L499I, and D469N. Briefly, the FokI Sharkey nuclease domain (SEQ ID NO:581) was fused N-terminal to Cas8 using a linker sequence (SEQ ID NO:582). For purification purposes, a hexahistine tag (His6, SEQ ID NO:583), followed by a MBP tag (SEQ ID NO:584), followed by a TEV protease cleavage sequence (SEQ ID NO:585), a nuclear localization signal (NLS, SEQ ID NO:586), and a GGS linker were appended N-terminal to residue 384 of FokI. The final construct comprised NH3-His6-MBP-TEV-NLS-GGS-FokISharkey-30aa-linker-Cas8-COOH in the protein sequence (SEQ ID NO:413).

In silico designed DNA sequences were provided to a commercial manufacturer (GenScript, Piscataway, NJ) for synthesis. The DNA sequences were cloned into a pET expression (MilliporeSigma, Hayward, CA) family vector backbone, which confers kanamycin resistance due to the presence of the kanR gene as described in Example 2 resulting in a vector carrying NH3-His6-MBP-TEV-NLS-GGS-FokISharkey-30aa-linker-Cas8-COOH (SEQ ID NO:439).

The *E. coli* Type I-E Cascade H3-His6-MBP-TEV-NLS-GGS-FokISharkey-30aa-linker-Cas8-COOH (SEQ ID NO:439) was expressed and purified as described in Example 4B and Example 5C. The protein sequence after TEV cleavage comprises NH3-NLS-GGS-FokISharkey-30aa-linker-Cas8-COOH (SEQ ID NO:587).

Similarly, a FokI-Cas8 fusion protein was constructed in a vector that carries NLS-FokI-linker-Cas8 His6-HRV3C-Cse2 Cas7 Cas5 Cas6 as described in Examples 1 and 2 (SEQ ID NO:442). Each expression vector was transfected into *E. coli* BL21 Star™ (Thermo Fisher Scientific, Waltham, MA) cells with a second vector encoding a guide RNA for the J3 target (SEQ ID NO:444), as described in Example 2. This construct was expressed and purified as described in Example 4B and Example 5A. Purification of the Cascade complexes comprising the fused FokI-Cas8 variants demonstrate that nuclease fused Type I-E CRISPR-Cas subunit proteins can be successfully used to form Cascade complexes having essentially the same composition (based on molecular weight) as Cascade complexes comprising wild-type proteins. FokI-Cas8 fusions were successfully used for biochemical cleavage of target nucleic acid (Example 7) and for in-cell cleavage of genomic sequences in eukaryotic cells (Example 8D and Example 9D).

Table 38 lists further examples of Cas subunit protein-enzyme fusions. In Table 38, APOBEC corresponds to a gene that is member of the cytidine deaminase pathway (human APOBEC I Genbank no. AB009426, human APOBEC 3F Genbank no. CH471095, human APOBEC 3G Genbank no. CR456472, rat APOBEC UCSC genome browser ID RGD:2133 rat); AID corresponds to an activation-induced cytidine deaminase (Genbank no. AY536516); PmCDA1 is an AID ortholog (see, e.g., Nishida, et al., Science 16:353 (2016); Iwamatsu, et al., J. Biochem. 110: 151-158 (1991)); PvuIIHIFIT46G is a PvuII high fidelity variant T46G (see, e.g., Fonfara, et al., Nucleic Acids Res. 40:847-860 (2012)); PvuIIsinglechainT46G is described in pdbID 3KSK); I-TevI is a site-specific, sequence-tolerant homing endonuclease from bacteriophage T4 and comprises an N-terminal catalytic domain as well as a C-terminal DNA-binding domain (the domains are connected by a long, flexible linker) (see, e.g., Van Roey, et al., EMBO J. 20:3631-3637 (2001)); BcnI (see, e.g., Sokolowska, et al., J. Mol. Biol. 369:722-734 (2007)); and MvaI (see, e.g., Kaus-Drobek, et al., Nucleic Acids Res. 35:2035-2046 (2007)) are restriction enzymes.

TABLE 38

Other Enzyme Fusions (Such as Nucleases and Cytidine Deaminases) with Cas8

| SEQ ID NO: | Enzyme | Fusion to Cas8 |
| --- | --- | --- |
| SEQ ID NO: 593 | Cas8_rAPOBEC1 | C terminal |
| SEQ ID NO: 594 | Cas8_AID | C terminal |
| SEQ ID NO: 595 | Cas8_PmCDA1 | C terminal |
| SEQ ID NO: 596 | Cas8_Human APOBEC1 | C terminal |
| SEQ ID NO: 597 | Cas8_APOBEC3F | C terminal |
| SEQ ID NO: 598 | Cas8_APOBEC3G | C terminal |
| SEQ ID NO: 599 | PvuIIHIFIT46G | N terminal |
| SEQ ID NO: 600 | PvuIIsinglechainT46G | N terminal |
| SEQ ID NO: 601 | I-TevI1-169Q158R | N terminal |
| SEQ ID NO: 602 | I-TevI1-169 | N terminal |
| SEQ ID NO: 603 | BcnI singlechain | N terminal |
| SEQ ID NO: 604 | MvaI singlechain | N terminal |
| SEQ ID NO: 605 | DNaseI | N terminal, C terminal |
| SEQ ID NO: 606 | Cas3 | N terminal |
| SEQ ID NO: 607 | S1 *Aspergillus* | N terminal, C terminal |

B. Cascade Subunit Protein Fusion with Another Cascade Subunit Protein

The two Cse2 proteins of the Cascade complex were fused together using a structure-guided approach based on the *E. coli* Cascade crystal structure 5H9E.pdb (www.rcsb.org/pdb/; see, e.g., Hayes, R. P, et al., Nature 530(7591): 499-503 (2016)). Briefly, the C-terminus of one Cse2 and the N-terminus of a second Cse2 were fused together using a 10-aa flexible linker (SEQ ID NO:589). The full sequence of the Cse2-Cse2 (CasB_CasB) fusion protein is shown in SEQ ID NO:588.

In silico designed DNA sequences were provided to a commercial manufacturer (GenScript, Piscataway, NJ) for synthesis. The DNA sequences were cloned into the expression vector designed in Example 2 (SEQ ID NO:441). The Cse2 sequence was exchanged with SEQ ID NO:588.

Each expression vector was transfected into *E. coli* BL21 Star™ (Thermo Fisher Scientific, Waltham, MA) cells with a second vector encoding a guide RNA for the J3 target (SEQ ID NO:444), as described in Example 2. The *E. coli* Type I-E Cascade complex containing Cas5, Cas6, Cas7, Cse2-Cse2, and Cas8 was expressed and purified as described in Example 4B and 5B. Purification of the Cascade complexes comprising the fused Cse2-Cse2 variant demonstrate that fused Type I-E CRISPR-Cas subunit proteins successfully formed Cascade complexes having essentially the same composition (based on molecular weight) as Cascade complexes comprising wild-type proteins.

C. Electrophoretic Mobility Shift Assays (EMSA) of Cascade/Cse2-Cse2 and J3 Target Purified Cascade/Cse2-Cse2 complexes were purified as described in this Example and subjected to an EMSA to demonstrate specific binding to their respective target sequence. Briefly, Cascade/Cse2-Cse2 and Cascade/WT-Cse2 were purified and concentrated to 10 mg/mL. Cy5 double-stranded target DNA was produced as described in Example 6A and diluted to 1M in TE buffer (J3 target SEQ ID NO:469 and SEQ ID NO:472 and CCR5 target SEQ ID NO:474 and SEQ ID NO:470). Cascade complexes and labeled double-stranded target DNA were incubated for 30 min at 37° C. at different protein/target ratios. Immediately following the incubation, 2 µl of 50% glycerol was added to the samples and they were loaded on a 5% native PAA gel. Gels were run at 4° C. at 70V for 90 min in 0.5×TBE buffer and imaged on an AZURE c600 Bioimager (Azure BioSystems, Dublin, CA) and the bands were quantitated. The data are presented in Table 39.

TABLE 39

Results of Cascade/Cse2-Cse2 EMSA

| Cascade ID and guide | Target DNA | Cascade:dsDNA ratio | Gel shift % |
| --- | --- | --- | --- |
| Cascade/wt-Cse2 J3 | J3 | 6.7 | 44 |
| Cascade/Cse2-Cse2 J3 | J3 | 6.7 | 46 |
| Cascade/wt-Cse2 J3 | CCR5 | 6.7 | LOD* |
| Cascade/Cse2-Cse2 J3 | CCR5 | 6.7 | LOD |

*LOD = below the limit of detection

D. Cascade Subunit Protein Fusion with Another Cascade Subunit Protein and an Enzymatic Protein Domain The cytidine deaminase rAPOBEC1 (apolipoprotein B mRNA editing enzyme catalytic subunit 1, *Rattus norvegicus*; NCBI Gene ID: 25383, uEnsembl:ENSRNOG00000015411) was selected for fusion. The Cse2-Cse2 protein was fused with rAPOBEC1 using a structure-guided approach based on the *E. coli* Cascade crystal structure 5H9E.pdb (www.rcsb.org/pdb/; see, e.g., Hayes, R. P, et al., Nature 530(7591):499-503 (2016)). Briefly, the C-terminus of rAPOBEC1 (SEQ ID NO:590) was fused to the N-terminus of the Cse2-Cse2 dimer (described above) using a 9-aa flexible linker (SEQ ID NO:591). The full sequence of the rAPOBEC1_Cse2-Cse2 fusion protein is shown in SEQ ID NO:592.

In silico designed DNA sequences were provided to a commercial manufacturer (GenScript, Piscataway, NJ) for synthesis. The DNA sequences were cloned into the expression vector (SEQ ID NO:441), replacing the Cse2 sequence. Each expression vector was transfected into *E. coli* BL21 Star™ (Thermo Fisher Scientific, Waltham, MA) cells with a second vector encoding a guide RNA for the J3 target (SEQ ID NO:444), as described in Example 2. The *E. coli*

Type I-E Cascade complex containing Cas5, Cas6, Cas7, rAPOBEC1_Cse2-Cse2, and Cas8 was expressed and purified as described in Example 4B and 5B. Purification of the Cascade complexes comprising the fused rAPOBEC1_Cse2-Cse2 variant demonstrate that cytidine deaminase fusions to Type I-E CRISPR-Cas subunit proteins were successfully used to form Cascade complexes having essentially the same composition (based on molecular weight) as Cascade complexes comprising wild-type proteins. Table 40 presents examples of enzyme fusions with Cse2-Cse2.

TABLE 40

Other Enzyme Fusions (Such as Cytidine Deaminases) with Cse2-Cse2

| SEQ ID NO: | Enzyme | Fusion to Cse2-Cse2 |
| --- | --- | --- |
| SEQ ID NO: 608 | rAPOBEC1 | N terminal |
| SEQ ID NO: 609 | AID | C terminal |
| SEQ ID NO: 610 | CPmCDA1 | C terminal |
| SEQ ID NO: 611 | Human APOBEC1 | N terminal |
| SEQ ID NO: 612 | Human APOBEC3F | N terminal |
| SEQ ID NO: 613 | APOBEC3G | N terminal |

Example 12

Cascade Subunit Protein Fusions to Transcription Activation/Repression Domains

This Example illustrates the design of a E. coli Type I-E cp-Cas7 protein fused to a VP64 activation domain to confer transcriptional activation activity to the Cascade complex.

VP64 is a transcriptional activator comprising four tandem copies of VP16 (herpes simplex viral protein 16, DALDDFDLDML (SEQ ID NO:614); amino acids 437-447, UNIPROT:UL48) connected with glycine-serine (GS) linkers. When fused to a protein domain that can bind near the promoter of a gene, VP64 (SEQ ID No:615) acts as a strong transcriptional activator. The E. coli Type I-E cp-Cas7 V2 (SEQ ID NO:616) can be selected for engineering.

The activation domain VP64 can be fused to the N-terminus of cpCas7 V2 (described in Example 10A). A linker (e.g., 5 to 50 amino acids in length) can be selected to operably link cpCas7 V2 and the VP64 domain.

In silico designed DNA sequences can be provided to a commercial manufacturer for synthesis. The DNA sequences encoding a VP64-cpCas7 V2 fusion protein can be cloned into an expression vector (e.g., SEQ ID NO:455, wherein VP64-cpCas7 V2 can be used to replace Cas7). Each expression vector can be transfected into E. coli BL21 Star™ (Thermo Fisher Scientific, Waltham, MA) cells with a second vector encoding a guide RNA for the J3 target (SEQ ID NO:444), as described in Example 2. The E. coli Type I-E Cascade complex containing Cas5, Cas6, VP64_cpCas7 V2, Cse2, and Cas8 can be expressed and purified as described in Examples 4 and 5. Purification of the Cascade complexes comprising the fused VP64_cpCas7 V2 variant can be used to form Cascade complexes having essentially the same composition (based on molecular weight) as Cascade complexes comprising wild-type proteins.

Selection of a guide targeted to the promoter region of a particular gene can be used to verify the ability of the Cascade complex comprising the fused VP64_cpCas7 V2 to facilitate transcriptional activation of the gene.

Example 13

Site-Directed Recruitment of Functional Domains Fused to Cascade Subunit by dCas9/Guide Complex This Example describes a method of engineering a Class 2 Type II CRISPR sgRNA, crRNA, tracrRNA, or crRNA and tracrRNA sequence with a Class 1 Type I CRISPR repeat stem sequence (e.g., a Type I-F CRISPR repeat stem sequence) for the recruitment of one or more Cascade subunit proteins (i.e., Cas6, Cas5, etc.) fused to a functional domain, to a Type II CRISPR Cas protein/guide RNA complex binding site. This method here is adapted from Gilbert, L., et. al., Cell 154(2):442-451 (2013) and Ferry, Q, et. al., Nature Communication 8:14633 doi: 10.1038/ncomms14633 (2017).

A. Engineering a Type II Guide RNA

A Type II CRISPR sgRNA, crRNA, tracrRNA, or crRNA and tracrRNA (collectively referred to as "Type II guide RNA") can be selected for engineering.

A Type II guide RNA sequence can be evaluated in silico for regions of incorporation of a Type I CRISPR repeat stem sequence. The Type I CRISPR repeat stem sequence can be attached at the 5' or 3' end of the Type II guide RNA, internal to the Type II guide RNA, or can replace secondary structure in the Type II guide RNA (e.g., 3' hairpin elements). Incorporation of the Type I CRISPR repeat stem sequence can be accompanied by a linker element nucleotide sequence. An example of a Type II tracrRNA 3' engineered to comprise a Type I CRISPR repeat stem sequence is presented in Table 41.

TABLE 41

Exemplary Type II tracrRNA with 3' Type I CRISPR Repeat Stem Sequence

| SEQ ID NO: | Sequence* |
| --- | --- |
| SEQ ID NO: 617 | 5'-AGCAUAGCAAGUUAAAAUAAGGCUAGUCCGU UAUCAACUUGAAAAAGUGGCACCGAGUCGGUGCU UAAGUUCAcugccguauaggcagCUUU-3' |

*Type I CRISPR repeat stem sequence is underlined and in lower case letters. A corresponding DNA coding sequence is presented as SEQ ID NO: 618.

A mammalian gene, such as C—X—C chemokine receptor type 4 (CXCR4), can be selected for targeting. The junction between the 5' UTR and exon 1 can be scanned in silico for a Type II CRISPR Cas protein target sequence occurring adjacent a Type II CRISPR Cas protein PAM sequence (e.g., 5'-NGG). The 20-nucleotide target sequence occurring upstream, in a 5' direction, can be incorporated into the Type II crRNA. An example of a Type II crRNA targeting CXCR4 is shown in Table 42.

TABLE 42

Exemplary Type II crRNA Targeting CXCR4

| SEQ ID NO: | Sequence* |
| --- | --- |
| SEQ ID NO: 619 | 5'-GAACCAGCGGUUACCAUGGAGUUUUAGAGCU AUGCU-3' |

*A corresponding DNA coding sequence is presented as SEQ ID NO: 620.

Alternatively, the 3' end of the CXCR4 targeting spacer (RNA) (SEQ ID NO:619) can be covalently linked to the 5' end of the Type II tracrRNA with 3' Type I CRISPR repeat stem sequence (RNA) (SEQ ID NO:617) with a linker. A suitable linker element is 5'-GAAA-3'.

In silico designed Type II guide RNAs with the incorporated Type I CRISPR repeat stem sequence can be provided to a commercial manufacturer for synthesis.

A Type I Cascade subunit protein (e.g., Cas6) can be operably linked to a transcriptional activation or repression domain (e.g., KRAB) and c-terminally tagged with a nuclear localization signal (NLS) as described in Example 12.

A Type II Cas protein (e.g., Cas9) can be mutated such that it is catalytically inactive (e.g. dCas9) and tagged with a NLS sequence.

The Cas6-KRAB-NLS protein and the dCas9-NLS protein can be recombinantly expressed and purified from *E. coli*.

RNP complexes can be formed at a concentration of 60 pmol dCas9 protein:60 pmol Cas6-KRAB-NLS:120 pmol: CXCR4 targeting crRNA:120 pmol tracrRNA 3' engineered to comprise a Type I CRISPR repeat stem sequence. Prior to assembly with the dCas9 and the Cas6-KRAB-NLS, each of the 120 pmol and 120 pmol CXCR4 targeting crRNA and 120 pmol tracrRNA 3' engineered to comprise a Type I CRISPR repeat stem sequence (herein referred to as "engineered Type II guide RNA") can be diluted to the desired total concentration (120 pmol) in a final volume of 2 µL, incubated for 2 minutes at 95° C., removed from a thermocycler, and allowed to equilibrate to room temperature. dCas9 and the Cas6-KRAB-NLS protein can be diluted to an appropriate concentration in binding buffer (20 mM HEPES, 100 mM KCl, 5 mM $MgCl_2$, and 5% glycerol at pH 7.4) to a final volume of 3 µL and mixed with the 2 µL of Type II guide RNA, followed by incubation at 37° C. for 30 minutes. An un-transfected control (e.g., buffer only), un-engineered Type II guide RNA, or a Cas6 not linked to a repression domain, can be used to assemble negative control RNPs.

B. Cell Transfections Using dCas9: Cas6-KRAB-NLS: Engineered Type II Guide RNA dCas9: Cas6-KRAB-NLS: engineered Type II guide RNA nucleoprotein complexes can be transfected into HEK293 cells (ATCC, Manassas VA), using the Nucleofector® 96-well Shuttle System (Lonza, Allendale, NJ) and the following protocol: The complexes can be dispensed in a 5 µL final volume into individual wells of a 96-well plate. The cell culture medium can be removed from the HEK293 cell culture plate and the cells detached with TrypLE™ (Thermo Scientific, Wilmington, DE). Suspended HEK293 cells can be pelleted by centrifugation for 3 minutes at 200×g, TrypLE reagents aspirated, and cells washed with calcium and magnesium-free phosphate buffered saline (PBS). Cells can be pelleted by centrifugation for 3 minutes at 200×g, the PBS aspirated, and the cell pellet re-suspended in 10 mL of calcium and magnesium-free PBS.

The cells can be counted using the Countess® II Automated Cell Counter (Life Technologies; Grand Island, NY). $2.2 \times 10^7$ cells can be transferred to a 1.5 ml microfuge tube and pelleted. The PBS can be aspirated and the cells re-suspended in Nucleofector™ SF (Lonza, Allendale, NJ) solution to a density of $1 \times 10^7$ cells/m. 20 µL of the cell suspension can be then added to each individual well containing 5 µL of RNP complexes, and the entire volume from each well can be transferred to a well of a 96-well Nucleocuvette™ (Lonza, Allendale, NJ) plate. The plate can be loaded onto the Nucleofector™ 96-well Shuttle™ (Lonza, Allendale, NJ) and cells nucleofected using the 96-CM-130 Nucleofector™ (Lonza, Allendale, NJ) program. Post-nucleofection, 70 µL Dulbecco's Modified Eagle Medium (DMEM; Thermo Scientific, Wilmington, DE), supplemented with 10% Fetal Bovine Serum (FBS; Thermo Scientific, Wilmington, DE), penicillin and streptomycin (Life Technologies, Grand Island, NY) can be added to each well, and 50 µL of the cell suspension can be transferred to a 96-well cell culture plate containing 150 µL pre-warmed DMEM complete culture medium. The plate can be transferred to a tissue culture incubator and maintained at 37° C. in 5% $CO_2$ for 48 hours.

72 hours after nucleofection of the dCas9: Cas6-KRAB-NLS: engineered Type II guide RNA nucleoprotein complexes, cells can be evaluated for repression of CXCR4 expression. Culture medium can be aspirated from the HEK293, and the cells can be washed once with calcium and magnesium-free PBS then are trypsinized by the addition of TrypLE (Life Technologies, Grand Island, NY) followed by incubation at 37° C. for 3-5 minutes. Trypsinized cells can be gently pipetted up and down to form a single cell suspension, and the cells can then be pelleted by centrifugation for 3 minutes at 200×g. After centrifugation, the culture medium can be aspirated and cells are re-suspended in a 10 mM EDTA/PBS buffer and gently mixed into a singles cell suspension. The single-cell suspension can be stained using 0.05% FITC conjugated to an anti-human CXCR4 antibodies (Medical & Biological Laboratories Co., Nagoya, Japan) in PBS containing 10% FBS for 1 hour at room temperature. Isotype controls and native RNP controls can be similarly stained for reference. Stained cells can then be sorted LSR II flow cytometer (BD laboratories, San Jose, CA) and population of FITC positive fluorescent cells tallied.

Reduction in CXCR4 expression is measure by a decrease in detected fluorescence of a dCas9: Cas6-KRAB-NLS: engineered Type II guide RNA nucleofected sample compared to the measured fluorescence of a non-transfected control. Decrease in fluorescence from the flow cytometer can be used to demonstrate that a engineered Type II guide RNA with a Type I CRISPR repeat stem sequence can be used in combination with a nuclease-deficient Type II Cas9 protein to recruit and localize a Type I CRISPR Cascade subunit protein fused to repression domain to a gene target and repress transcription of said gene target.

Example 14

Identification and Screening of Type I cas Genes

This Example describes a method to identify and screen Type I cas genes from different species. The method presented here is adapted from Shmakov, S., et al., Mol. Cell 60:385-397 (2015).

A. Identification of Type I CRISPR-Cas Genes

Using the Basic Local Alignment Search Tool (BLAST, blast.ncbi.nlm.nih.gov/Blast.cgi), a search of the genomes of various species can be conducted to identify one or more genes coding for the various gene component of the Type I CRISPR-Cas complex. The cas1 integrase gene is a component of both Class 1 and Class 2 CRISPR-Cas families, and upon identification of species containing the cas1 gene, subsequence searcher in these genomes can be conducted to isolate genomes comprising Type I-specific genes. Genome searches can be anchored upon the CRISPR-Cas integrase genes cas1, an exemplary cas1 sequence from the Type I-E system from *E. coli* K-12 MG1655 that can be used is SEQ ID. NO:621. Particular genes (e.g., cas7 and cas5) are core components of the interference complexes of the Type I systems and can be used to further differentiate species containing Type I systems. Exemplary sequences of *E. coli* K-12 MG1655 cas7 and cas5 genes that can be used are SEQ ID. NO:622 and SEQ ID. NO:623, respectively. Genomes identified possessing cas7 and cas5 genes can be further parsed through the identification of the Type I-specific nuclease-helicase cas3 gene or homologs thereof. An exemplary sequence of a *E. coli* K-12 MG1655 cas3 sequence that can be used is SEQ ID. NO:624.

Genomes containing CRISPR-Cas integrase genes cas1, Type I interference complex genes cas7 and cas5, and the nuclease-helicase cas3 gene, or some combination thereof, are likely candidates of Type I CRISPR-Cas system(s). Type I CRISPR-Cas genes are generally found in proximity to one in a single genomic locus, typically within 20 kilobases (kb). The area around the cas1, cas7, cas5, or cas3 genes can be searched for other open reading frames (ORFs) of the remaining cas genes that constitute a Type I interference complex. The amino acid sequence of putative ORFs can be compared to known Type I genes for homology or the presence of characteristic protein domains of the Type I protein components can be analyzed using the homology detection and structure prediction search tools available through the Max Planck Institute Bioinformatics Toolkit (www.toolkit.tuebingen.mpg.de/#/), or equivalent.

B. Screening of Identified Type I Components

Once a putative collection of Type I components (e.g., cas genes and the corresponding crRNA) have been identified, the Type I components can be tested for their ability to carry out programmable DNA targeting.

Putative cas genes and the crRNA can be encoded into expression vectors following the guidance of Examples 1, 2, and 3. Vectors encoding the various cas genes and crRNA can be introduced into a bacteria strain and the Type I interference complex expressed and purified as described in Examples 4 and 5. The elution fraction from the size-exclusion chromatography (SEC) column, can be analyzed via SDS-PAGE gel to determine the identity, based on weight, of the protein components comprising a complete Type I interference complex. An ethidium bromide gel can also be run to detect the presence of crRNA as part of the interference complex.

Purified Cascade complexes can be tested for their ability to support in vitro biochemical cleavage of a DNA target as described in Examples 6 and 7.

Control expressions and purification samples, where single putative cas gene are not expressed, can be used to determine the required cas genes that constitute a complete Type I interference complex capable of programmable DNA target.

For certain applications, identification of individual cas gene homologs (e.g., cas7) from a genomic sequence is sufficient and additional cas genes need not be identified nor screening performed.

Example 15

Identification of Type I crRNAs

This Example describes a method to identify Type I crRNAs in different species. The method presented here is adapted from Chylinski, K., et al., RNA Biology 10:726-737 (2013).

A search of genomes of various species can be conducted to identify Type I CRISPR-Cas genes as described in Example 17A. Genomes that comprise one of more Type I specific cas genes are candidate genomes that likely to contain CRISPR RNAs (crRNAs) encoded within the CRISPR repeat-spacer array. The sequences adjacent to the identified Type I cas genes (e.g., a cas7, cas5, or cas3 gene) can be probed for an associated CRISPR repeat-spacer array. Methods for in silico predictive screening can be used to extract the crRNA sequence from the repeat array following Grissa, I. V., et. al. Nucleic Acids Res. 35(Web Server issue):W52-W57 (2007). The crRNA sequence is contained within CRISPR repeat array and can be identified by its hallmark repeating sequences interspaced by foreign spacer sequences.

A. Preparation of RNA-seq Library

The putative CRISPR array containing the individual crRNA identified in silico can be further validated using RNA sequencing (RNA-seq).

Cells from species identified as comprising putative Type I cas genes and crRNA components can be procured from a commercial repository (e.g., ATCC, Manassas, VA; German Collection of Microorganisms and Cell Cultures GmbH (DSMZ), Braunschweig, Germany).

Cells can be grown to mid-log phase and total RNA prepped using Trizol reagent (SigmaAldrich, St. Louis, MO) and treated with DNaseI (Fermentas, Vilnius, Lithuania).

10 μg of the total RNA can be treated with Ribo-Zero rRNA Removal Kit (Illumina, San Diego, CA) and the remaining RNA purified using RNA Clean and Concentrators (Zymo Research, Irvine, CA).

A library can be prepared using a TRUSEQ™ Small RNA Library Preparation Kit (Illumina, San Diego, CA), following the manufacturer's instructions. This will result in cDNAs having adapter sequences.

The resulting cDNA library can be sequenced using MiSeq Sequencer (Illumina, San Diego, CA).

B. Processing of Sequencing Data

Sequencing reads of the cDNA library can be processed, for example, using the following method.

Adapter sequences can be removed using cutadapt 1.1 (pypi.python.org/pypi/cutadapt/1.1) and about 15 nucleotides trimmed from the 3' end of the read to improve read quality.

Reads can be aligned to the genome of the respective species (i.e., from which the putative crRNA is to be identified) using Bowtie 2 (www.bowtie-bio.sourceforge.net/bowtie2/index.shtml). The Sequence Alignment/Map (SAM) file, which is generated by Bowtie 2, can be converted into a Binary Alignment/Map (BAM) file using SAMTools (www.samtools.sourceforge.net/) for subsequent sequencing analysis steps.

Read coverage mapping to the CRISPR locus or loci can be calculated from the BAM file using BedTools (bedtools.readthedocs.org/en/latest/).

The BED file, as generated in the previous step, can be loaded into Integrative Genomics Viewer (IGV; www.broadinstitute.org/igv/) to visualize the sequencing read pileup. Read pile can be used to identify the 5' and 3' termini of the transcribed putative crRNA sequence. The RNA-seq data can be used to validate that a putative crRNA element is actively transcribed in vivo.

Putative crRNA can be tested with their cognate Type I cas genes for the ability to carry out programmable DNA targeting following the guidance of Example 17A.

Example 16

Probing for Sites Tolerant of Changes in Cascade Guide RNA Backbones

This Example describes the generation and testing of various changes to Type I guide crRNAs and their suitability for use in constructing Cascade polynucleotide complexes. The method described below is adapted from Briner, A., et al., Mol. Cell 56:333-339 (2014).

Changes can be introduced into the crRNA backbone, and the resulting engineered crRNA tested with a cognate Cascade complex to facilitate the identification of regions or positions in the Type I guide crRNA backbone amenable to engineering.

A crRNA from a Type I CRISPR system (e.g., *E. coli* Cascade) can be selected for engineering. The crRNA sequence can be engineered in silico to introduce one or more base changes (e.g., substitutions, changes, mutations, deletions, and/or insertions into nucleic acid sequences in regions selected from one or more of the following regions: nucleic acid sequences 5' of the spacer (5' handle), the spacer element, Type I CRISPR repeat stem sequence, or 3' of the Type I CRISPR repeat stem sequence (3' handle).

Base changes can also be used to introduce mismatches in the hydrogen base-pair interactions of any of the crRNA regions, or base-pair mutation introducing an alternative hydrogen base-pair interaction through substitution of two bases, wherein the alternative hydrogen base-pair interaction differs from the original hydrogen base-pair interaction (e.g., the original hydrogen base-pair interaction is Watson-Crick base pairing and the substitution of the two bases form a reverse Hoogsteen base pairing). Substitution of bases can also be used to introduce hydrogen base-pair interaction within the crRNA backbone.

Regions of the crRNA can be independently engineered to introduce secondary structure elements into the crRNA backbone. Such secondary structure elements include, but are not limited to, the following: stem-loop elements, stem elements, pseudo-knots, and ribozymes. Furthermore, the crRNA backbone can be engineered to delete portions of the crRNA backbone either through deletion at the 5' end, 3' end, or internal to the crRNA. Alternative backbone structures can also be introduced.

In silico designed crRNA sequences can be provided to a commercial manufacturer for synthesis.

Engineered crRNAs can be evaluated for their ability to support binding by individual Cascade subunit proteins (i.e., Cas6, Cas5, etc.), or to support complete formation of the Cascade protein complex, or to support formation of the Cascade complex and modification of a double-stranded DNA target sequence through recruitment of a nuclease (e.g., Cas3). crRNA binding to individual Cascade subunit proteins and Cascade protein complex assembly can be evaluated by nano-ESI mass spectrometry in a manner similar to Jore, M., et al., Nature Structural & Molecular Biology 18:529-536 (2011). Biochemical characterization of crRNA and Cascade protein complex modification of a double-stranded DNA target sequence through recruitment of a nuclease can be carried out in a manner similar to those described in Examples 6 and 7. Engineered crRNA that are capable of supporting formation of the Cascade complex and modification of a double-stranded DNA target sequence through recruitment of a nuclease can be validated for activity in cells using the method described in Example 8A, Example 8B, Example 8C, and Example 8D.

Example 17

Screening of Cascade Complex Guides Comprising DNA Target Binding Sequences

This Example illustrates the use of Type I CRISPR proteins and Type I guide crRNAs of the present invention to modify DNA target sequences present in human gDNA (gDNA) and to measure the level of cleavage activity at those sites.

Target sites (DNA target sequences) can be first selected from gDNA. Type I guide crRNAs can be designed to target the selected sequences. Assays (e.g., as described in Example 7) can be performed to determine the level of DNA target sequence cleavage.

A. Selecting DNA Target Sequences from gDNA

PAM sequences (e.g., ATG) for a Cascade protein complex (e.g., *E. coli* Type I-E Cascade) can be identified within the selected genomic region.

One or more Cascade DNA target sequences (e.g., 32 nucleotides in length) that are 3' adjacent to an ATG PAM sequence can be identified.

Criteria for selection of nucleic acid target sequences can include, but are not limited to, the following: homology to other regions in the genome; percent G-C content; melting temperature; presences of homopolymer within the spacer; distance between the two sequences; and other criteria known to one skilled in the art.

A DNA target binding sequence that hybridizes to the Cascade DNA target sequence can be incorporated into a guide crRNAs. The nucleic acid sequence of a guide crRNA construct is typically provided to and synthesized by a commercial manufacturer.

A guide crRNA, as described herein, can be used with cognate Type I Cascade protein complex to form crRNA/Cascade protein complexes.

B. Determination of Cleavage Percentages and Specificity

In vitro cleavage percentages and specificity (i.e., the amount of off-target binding) related to a guide crRNA can be determined, for example, using the cleavage assays described in Example 7, and compared as follows:

(1) If only a single DNA target sequences is identified or selected for a guide crRNA, the cleavage percentage and specificity for each of the DNA target sequences can be determined. If so desired, cleavage percentage and/or specificity can be altered in further experiments using methods including, but not limited to, engineering the guide crRNA, or introducing effector proteins/effector protein-binding sequences to engineer the guide crRNA or the Cascade subunit proteins, or ligand/ligand-binding moieties to engineer the guide crRNA or the Cascade subunit proteins.

(2) If multiple DNA target sequences are identified or selected for guide crRNAs, the percentage cleavage data and site-specificity data obtained from the cleavage assays can be compared between different DNAs comprising the target binding sequence to identify the DNA target sequences having the desired cleavage percentage and specificity. Cleavage percentage data and specificity data provide criteria on which to base choices for a variety of applications. For example, in some situations the activity of the guide crRNA may be the most important factor. In other situations, the specificity of the cleavage site may be relatively more important than the cleavage percentage. If so desired, cleavage percentage and/or specificity can be altered in further experiments using methods including, but not limited to, engineering the guide crRNA, introducing effector proteins/effector protein-binding sequences to engineer the guide crRNA or the Cascade subunit proteins, or ligand/ligand-binding moieties to engineer the guide crRNA or the Cascade subunit proteins.

Alternatively, or in addition to the in vitro analysis, in-cell cleavage percentages and specificities of guide crRNAs can be obtained using, for example, the method described in Example 8C and Example 8D, and compared as follows:
(1) If only a single DNA target sequences is identified or selected for a guide crRNA, the cleavage percentage and specificity for each of the DNA target sequences can be determined. If so desired, cleavage percentage and/or specificity can be altered in further experiments using methods including, but not limited to, engineering the guide crRNA, or introducing effector proteins/effector protein-binding sequences to engineer the guide crRNA or the Cascade subunit proteins, or ligand/ligand-binding moieties to engineer the guide crRNA or the Cascade subunit proteins.
(2) If multiple DNA target sequences are identified or selected for guide crRNAs, the percentage cleavage data and site-specificity data obtained from the cleavage assays can be compared between different DNAs comprising the target binding sequence to identify the DNA target sequences having the desired cleavage percentage and specificity. Cleavage percentage data and specificity data provide criteria on which to base choices for a variety of applications. For example, in some situations the activity of the guide crRNA may be the most important factor. In other situations, the specificity of the cleavage site may be relatively more important than the cleavage percentage. If so desired, cleavage percentage and/or specificity can be altered in further experiments using methods including, but not limited to, engineering the guide crRNA, introducing effector proteins/effector protein-binding sequences to engineer the guide crRNA or the Cascade subunit proteins, or ligand/ligand-binding moieties to engineer the guide crRNA or the Cascade subunit proteins.

Example 18

Varying FokI-Cas8 Linker Composition and Interspacer Distance for Efficient FokI-Cascade Complex Genome Editing This Example illustrates the design and testing of multiple fusion proteins comprising FokI-Cas8 and linker polypeptides of various lengths, as well as the effect of varying interspacer distances for efficient genome editing.

A. Production of a Vector Encoding *E. Coli* Type I-E Cascade Complex Components Comprising FokI Fusion Proteins to be Transfected into Target Cells Minimal CRISPR arrays were designed to target a set of loci in the human genome at or near two different genes: ADAMTSL1 and PCSK9. Interspacer distances ranged from 14-60 bp, in increments of 2 bp. Four targets were designed for each interspacer distance. Targets were flanked by either AAG or ATG PAM sequences. Coding sequences for guides containing "repeat-spacer-repeat-spacer-repeat" sequences were cloned as described in Example 9A with SEQ ID NO:454. SEQ ID NO:625 through SEQ ID NO:816 provide the sequences for the full set of oligonucleotide sequences used to generate the minimal CRISPR arrays.

FokI-Cascade RNP subunit protein component-encoding genes were cloned into vectors comprising: CMV promoters to enable delivery and expression in mammalian cells; cas genes linked via 2A viral peptide "ribosome-skipping" sequences; a fusion protein comprising FokI and Cas8 connected with a 30-aa linker (SEQ ID NO:455). Additional linker polypeptide sequences of varying length and amino acid composition were designed and used to connect FokI to the Cas8 protein in these vectors. The additional linker polypeptide sequences are listed in Table 43.

TABLE 43

Amino Acid Linker Sequences

| SEQ ID NO: | Linker length (amino acids) | Amino acid sequence |
|---|---|---|
| SEQ ID NO: 817 | 5 | GGGGS |
| SEQ ID NO: 818 | 8 | TGPGAAAR |
| SEQ ID NO: 819 | 10 | GGSGSSGGSG |
| SEQ ID NO: 820 | 15 | GGSGSSGGSGSSGGS |
| SEQ ID NO: 821 | 17 | ADPTNRAKGLEAVSVAS |
| SEQ ID NO: 822 | 20 | SGSETPGTSESATPESGGSG |
| SEQ ID NO: 433 | 30 | SGSETPGTSESATPESGGSGSSGGSGSSGG |
| SEQ ID NO: 823 | 40 | SGSETPGTSESATPESGGSGSSGGSGSSGGSGSSGGSGSS |
| SEQ ID NO: 824 | 50 | SGSETPGTSESATPESGGSGSSGGSGSSGGSGSSGGSGSSGGSGSSGGSG |

B. Transfection of Vectors Encoding FokI-Cascade RNP Complex Components

Transfection conditions were essentially as described in Example 8B with the following modifications. Prior to nucleofection, 5 µl of plasmid vector solution was transferred to individual wells of a 96-well plate. Each well contained 2.4 µg of plasmid encoding FokI-Cascade RNP complex subunit protein components and ~1-2 µg of plasmid encoding the minimal CRISPR array.

C. Deep Sequencing of gDNA from Transfected cells

Deep sequencing was performed essentially as described in Example 8C with the following modifications. Instead of primers Y and Z from Table 36 of Example 8C, the target-specific primers were SEQ ID NO:825 to SEQ ID NO:1016.

D. Deep Sequencing Data Analysis

Figure 31A:
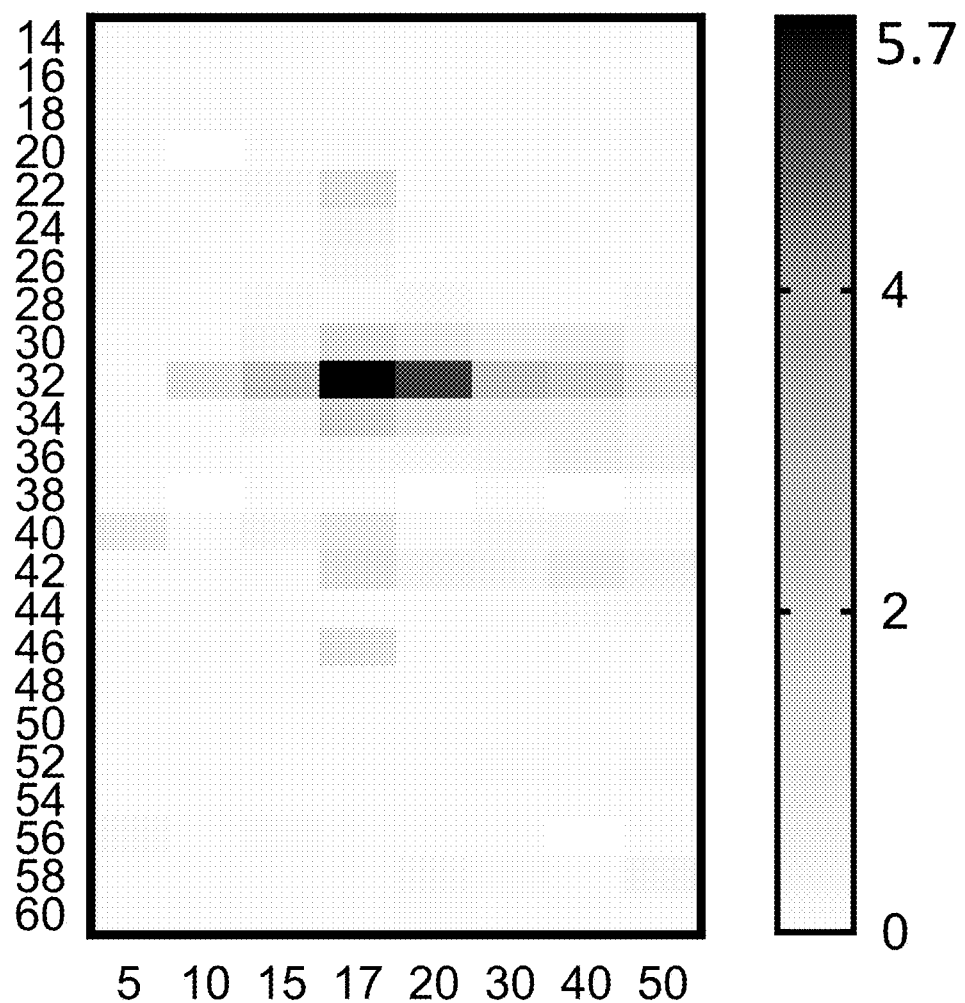

Deep sequencing data analysis was performed essentially as described in Example 8D. FIG. 31A and FIG. 31B present the results of the data analysis. In FIG. 31A and FIG. 31B, percent genome editing is shown as a function of FokI-Cas8 linker type (FIG. 31A, FIG. 31B, vertical axis 14-60 AA) and interspacer distance (n=1) (FIG. 31A, FIG. 32B, horizontal axis, interspacer distance 5-50 bp. In FIG. 31A, the grey scale vertical bar to the right is percentage of indels. In FIG. 32B, values in the cells are the percent indels. An initial analysis of the data showed genome editing was highest with FokI-Cas8 linkers of 17 and 20 amino acids (SEQ ID NO:821 and SEQ ID NO:822, respectively) and with interspacer distances of ~26 bp and ~30-32 bp. The data was reprocessed and samples with less than a thousand sequences reads were removed as they may contain inflated editing values due to low coverage (sites were only retained if all the associated samples contained >1000 reads). This data, presented in FIG. 31A and FIG. 31B, showed that genome editing was highest with FokI-Cas8 linkers of 17 and 20 amino acids (SEQ ID NO:821 and SEQ ID NO:822, respectively) and with interspacer distances of ~30-32 bp. Thus, efficient genome editing using Type I CRISPR-Cas complexes comprising FokI-Cas8 fusion proteins was achieved by varying the interspacer distance and the linker polypeptide length of the FokI-Cas8 fusion protein. The amino acid composition of the linker polypeptides is discussed herein.

Example 19

Identifying Cascade Homologs for Genome Editing

This Example illustrates the design and testing of multiple homolog Cascade complexes to evaluate the efficiency of genome editing.

A. Identification of Sites for Testing with Homolog Cascade Complexes

A panel of sites was identified for testing additional homolog Cascade complexes. Specifically, minimal CRISPR arrays were designed to target a set of loci in the human genome with 30-bp interspacer distances and that were flanked by either AAG or ATG PAM sequences. Guide polynucleotides containing "repeat-spacer-repeat-spacer-repeat" sequences were cloned following the method described in Example 9A with SEQ ID NO:454. The full set of oligonucleotide sequences used to generate the minimal CRISPR arrays are presented as SEQ ID NO:1017 to SEQ ID NO:1130 (Hsa33F, SEQ ID NO:1017, and Hsa33R, SEQ ID NO:1074, exemplify one pair). A positive control comprising guides targeting the TRAC locus was included (SEQ ID NO:454).

FokI-Cascade RNP subunit protein component-encoding genes were cloned into vectors comprising: CMV promoters to enable delivery and expression in mammalian cells; cas genes linked via 2A viral peptide "ribosome-skipping" sequences; a fusion protein comprising FokI and Cas8 connected with a 30-aa linker (SEQ ID NO:455).

B. Transfection of Vectors Encoding FokI-Cascade RNP Complex Components

Transfection conditions were performed essentially as described in Example 8B with the following modifications. Prior to nucleofection, 5 µl of plasmid vector solution was transferred to individual wells of a 96-well plate. Each well contained 3 µg of plasmid encoding FokI-Cascade RNP subunit protein components and 0.3 µg of plasmid encoding the minimal CRISPR array.

C. Deep Sequencing of gDNA from Transfected Cells

Deep sequencing was performed essentially as described in Example 8C with the following modifications. Instead of primers Y and Z from Table 36 of Example 8C, the target-specific primers used in this Example were SEQ ID NO:1131 to SEQ ID NO:1244.

D. Deep Sequencing Data Analysis

Figure 32:
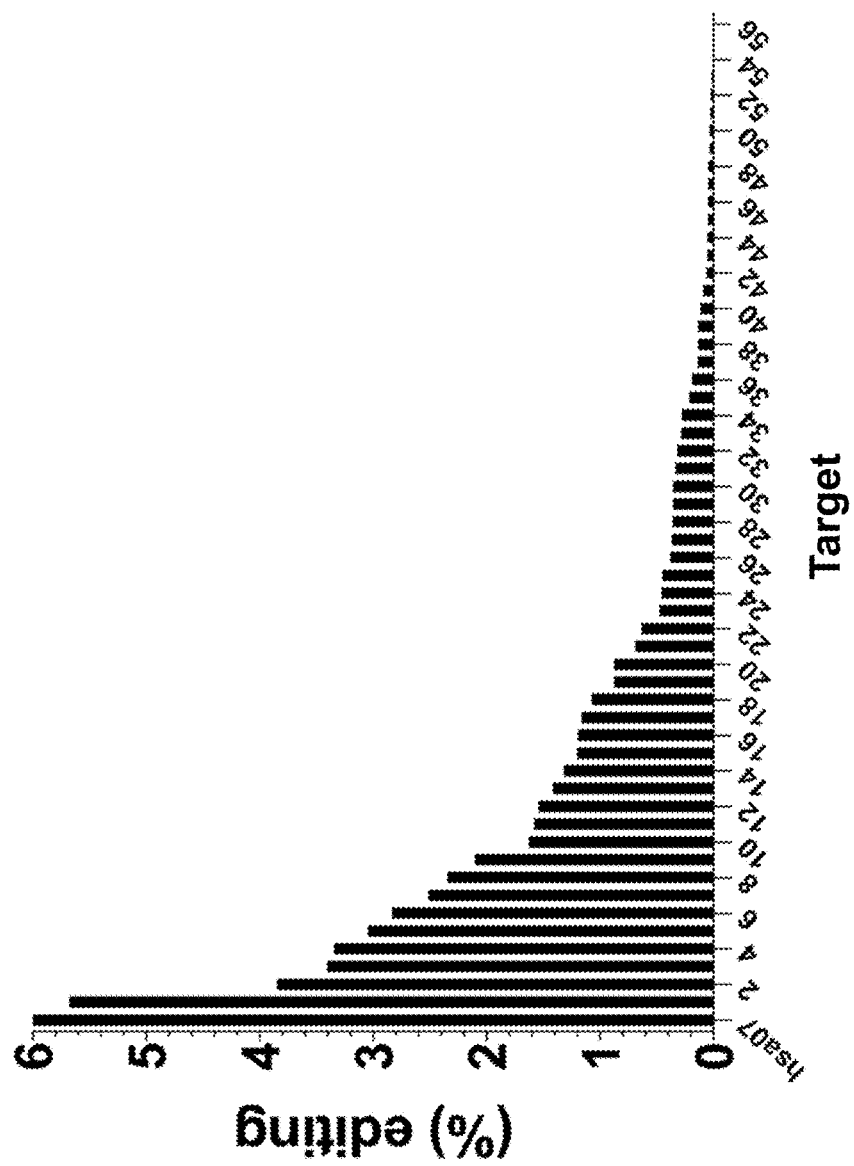

Deep sequencing data analysis was performed essentially as described in Example 8D. FIG. 32 present the results of the data analysis. In FIG. 32, percent genome editing (FIG. 32, vertical axis, % editing) is plotted against 58 test sites (FIG. 32, horizontal axis, "Target"; oligonucleotide sequences used to generate these minimal CRISPR arrays are discussed above) in addition to target Hsa07 from Example 8A (n=3). As is shown in FIG. 32, editing ranged from ~6% to below the limit of detection. From these data, a panel of eight sites (Hsa07 as well as targets 1, 3-5, 10, 13, and 16 corresponding to the following targets Hsa37, Hsa43, Hsa46, Hsa60, Hsa77, Hsa88, and Hsa126) with AAG PAMs were selected for testing homolog Cascade complexes for genome editing.

E. Identification of Homolog Cascade Complexes to Test with FokI Nuclease for Genome Editing Cas8 protein sequences from different Type I systems were used as queries for psi-BLASTp to generate phylogenetic trees for homolog selection. Specifically, Cas8 from *Fusobacterium nucleatum* (WP_008798978.1) was used for Type I-B, Cas8 from *Bacillus halodurans* (WP_010896519.1) was used for Type I-C, Cas8 from *E. coli* (WP_001050401.1) was used for Type I-E, Cas8 from *Pseudomonas aeruginosa* (WP_003139224.1) was used for Type I-F, and Cas5 from *Shewanella putrefaciens* (WP_011919226.1) was used for Type I-Fv2.

Next, psi-BLASTp was iterated multiple times until thousands of homologs were identified for each Type I system. From this information, phylogenetic trees were built using the interactive Tree of Life online software (iTOL, accessible at itol.embl.de/login.cgi). The trees were visually inspected after auto-collapsing clades using variable branch lengths.

Lists of organisms falling within major clades were then outputted and manually inspected for selection. In this step, priority was placed on selecting homologs that sampled from different regions of the phylogenetic tree, both for the 12 homologs within the Type I-E as well as 2-3 representative homologs for Types I-B, I-C, I-F, and I-Fv2. cas8 and cas5 candidates, based on the above phylogenetic analysis, were inputted into NCBI, and the genomic context within the endogenous host bacterium was visually inspected within NCBI's genome graphics browser. Cascade homologs were selected only if (1) they were found in organisms that grow at 37° C.; (2) their cas gene operons were intact and had all the expected Cascade subunit protein encoding genes, a cas3 gene, and intact acquisition genes (i.e., cas1 and cas2); (3) their cas gene operon was flanked by one or more CRISPR arrays; and (4) their CRISPR arrays contained >10 spacers. For some homologs, the CRISPRfinder program (crispr.i2bc.paris-saclay.fr/Server/) was used to identify putative PAM sequences. Based on the above criteria, the 22 homolog Cascade complexes shown in Table 44 were selected.

G. Transfection of Plasmids Encoding FokI-Cascade RNP Complexes

Transfection conditions were essentially as described in Example 8B with the following modifications. Prior to nucleofection, 5 µl of plasmid vector solution was transferred to individual wells of a 96-well plate. Each well contained 1.5 µg of plasmid encoding FokI-Cascade RNP subunit protein components and ~0.5-1.5 µg of plasmid encoding the minimal CRISPR array. Experiments were

TABLE 44

Homolog Cascade Complexes

| SEQ ID NO: | Cascade homolog organism | PAM | Spacer length | Type |
|---|---|---|---|---|
| SEQ ID NO: 1245 | Oceanicola sp. HL-35 | AAG | 32 | I-E |
| SEQ ID NO: 1246 | Pseudomonas sp. S-6-2 | AAG | 32 | I-E |
| SEQ ID NO: 1247 | Salmonella enterica subsp. enterica serovar Muenster strain | AAG | 32 | I-E |
| SEQ ID NO: 1248 | Atlantibacter hermannii NBRC 105704 | AAG | 32 | I-E |
| SEQ ID NO: 1249 | Geothermobacter sp. EPR-M | AAG | 32 | I-E |
| SEQ ID NO: 1250 | Methylocaldum sp. 14B | AAG | 32 | I-E |
| SEQ ID NO: 1251 | Methanocella arvoryzae MRE50 | AAG | 32 | I-E |
| SEQ ID NO: 1252 | Pseudomonas aeruginosa DHS01 | AAG | 32 | I-E |
| SEQ ID NO: 1253 | Lachnospiraceae bacterium KH1T2 | GAA | 35 | I-E |
| SEQ ID NO: 1254 | Klebsiella pneumoniae strain VRCO0172 | GAA | 33 | I-E |
| SEQ ID NO: 1255 | Streptococcus thermophilus strain ND07 | GAA* | 33 | I-E |
| SEQ ID NO: 1256 | Streptomyces sp. S4 | GAA | 33 | I-E |
| SEQ ID NO: 1257 | Campylobacter fetus subsp. testudinum Sp3 | TCA | 36 | I-B |
| SEQ ID NO: 1258 | Odoribacter splanchnicus DSM 20712 | TCA | 36 | I-B |
| SEQ ID NO: 1259 | Bacillus halodurans C-125 | TTC | 34 | I-C |
| SEQ ID NO: 1260 | Desulfovibrio vulgaris RCH1 plasmid pDEVAL01 | TTC | 34 | I-C |
| SEQ ID NO: 1261 | Geobacillus thermocatenulatus strain KCTC 3921 | TTC | 35 | I-C |
| SEQ ID NO: 1262 | Vibrio cholerae strain L15 L15_contig8 | CC | 32 | I-F |
| SEQ ID NO: 1263 | Pseudomonas aeruginosa UCBPP-PA14 | CC | 32 | I-F |
| SEQ ID NO: 1264 | Shewanella putrefaciens CN-32 | CC | 32 | I-Fv2 |
| SEQ ID NO: 1265 | Acinetobacter sp. 869535 | CC | 32 | I-Fv2 |
| SEQ ID NO: 1266 | Vibrio cholerae HE48 vcoHE48.contig.11 | CC | 32 | I-Fv2 |

*as identified by Sinkunas, T., et al., EMBO J. 32: 385-394 (2013); however, the data presented herein demonstrates that Streptococcus thermophilus strain ND07 can utilize a single A as a PAM sequence in vivo.

F. Production of Vectors Encoding FokI-Cascade RNP Components from 22 Distinct Species for Transfection into Target Cells Sequences for each cas gene from each homolog were synthesized as part of a polycistronic construct that included a fusion protein comprising FokI nuclease and Cas8. For each Type I-E Cascade complex homolog, a set of ~7-8 guides targeting loci with the appropriate PAM sequences were generated. For each Type I-B, I-C, I-F, and I-Fv2 Cascade homolog, a set of ~2-7 guides targeting loci with appropriate PAM sequences were generated. Each Cascade complex homolog system required unique repeat sequences to process their cognate guide (SEQ ID NO:1267 to SEQ ID NO:1288). Coding sequences for guides containing "repeat-spacer-repeat-spacer-repeat" sequences were cloned using the method described in Example 9A for SEQ ID NO:454. Oligonucleotides were phosphorylated on the 5' end and appended with overhang sequences to enable cloning into plasmid vectors with the appropriate repeat sequences. The full set of oligonucleotide sequences used to generate the minimal CRISPR arrays for the 22 Cascade complex homologs are presented as (SEQ ID NO:1289 to SEQ ID NO:1400).

FokI-Cascade RNP subunit protein component-encoding genes were cloned into vectors comprising: CMV promoters to enable delivery and expression in mammalian cells; cas genes linked via 2A viral peptide "ribosome-skipping" sequences; a fusion protein comprising FokI and Cas8 connected with a 30-aa linker.

performed in triplicate and included FokI-Cascade RNP complexes from E. coli (SEQ ID NO:455) targeted to eight sites (Hsa07 from Example 8A and Hsa37, Hsa43, Hsa46, Hsa60, Hsa77, Hsa88, Hsa126 from Example 19F and Example 19G) as positive controls. As previously described, the following oligonucleotides were used to generate the minimal CRISPR arrays used with the E. coli positive control: Hsa37 (SEQ ID NO:1019; SEQ ID NO:1076), Hsa43 (SEQ ID NO:1024; SEQ ID NO:1081), Hsa46 (SEQ ID NO:1027; SEQ ID NO:1084), Hsa60 (SEQ ID NO:1037; SEQ ID NO:1094), Hsa77 (SEQ ID NO:1045; SEQ ID NO:1102), Hsa88 (SEQ ID NO:1050; SEQ ID NO:1107), Hsa126 (SEQ ID NO:1072; SEQ ID NO:1129).

H. Deep Sequencing of gDNA from Transfected Cells

Deep sequencing was performed essentially as described in Example 8C with the following modifications. Instead of primers Y and Z from Table 36 of Example 8C, the target-specific primers used in this Example were SEQ ID NO:1401 to SEQ ID NO:1512. For both Type I-E RNP complexes and Type I-B, I-C, I-F, and I-Fv2 RNP complexes, control samples comprising E. coli Type I-E Cascade were included for comparison and sequenced with target-specific primers corresponding to targets Hsa07 from Example 8A and Hsa37, Hsa43, Hsa46, Hsa60, Hsa77, Hsa88, Hsa126 from this Example. More specifically, the following target-specific amplification primers were used for these targets: Hsa37 (SEQ ID NO:1133; SEQ ID NO:1190), Hsa43 (SEQ ID NO:1138; SEQ ID NO:1195), Hsa46 (SEQ ID NO:1141; SEQ ID NO:1198), Hsa60 (SEQ ID NO:1151;

SEQ ID NO:1208), Hsa77 (SEQ ID NO:1159; SEQ ID NO:1216), Hsa88 (SEQ ID NO:1164; SEQ ID NO:1221), Hsa126 (SEQ ID NO:1186; SEQ ID NO:1243).

I. Deep Sequencing Data Analysis

Deep sequencing data analysis was performed essentially as described in Example 8D. FIG. 33A and FIG. 33B show results from these experiments. In FIG. 33A, the vertical axis is percent editing (FIG. 33A, % editing) and the numbers on the horizontal axis are SEQ ID Nos. corresponding to Type I-E homolog systems. Editing was observed with many of the Type I-E FokI-Cascade homologs (FIG. 33A). The highest editing was observed with the variant from *Pseudomonas* sp. S-6-2, while other homologs (i.e., *Salmonella enterica, Geothermobacter* sp. EPR-M, *Methanocella arvoryzae* MRE50, and *S. thermophilus* (strain ND07)) showed editing approximately equivalent to *E. coli*. In FIG. 33B, the vertical axis is percent editing (FIG. 33B, % editing) and the numbers on the horizontal axis are SEQ ID Nos. corresponding to Type I-B, I-C, I-F, and I-Fv2 homolog systems. Editing with FokI-Cascade RNPs derived from Types I-B, I-C, I-F, and I-Fv2 was below the limit of detection (FIG. 33B).

This Example provides methods for screening Type I homologs to identify Type I systems that provide genomic editing capability. Additional Type I homolog screening is described in Example 22.

Example 20

Varying FokI-Cas8 Linker Length and Interspacer Distances in *Pseudomonas* sp S-6-2 for Efficient Genome Editing This Example illustrates the design and testing of multiple fusion proteins comprising FokI-Cas8 and linker polypeptides of various lengths, as well as the effect of varying interspacer distances for efficient genome editing with *Pseudomonas* sp S-6-2 Type I-E CRISPR-Cas systems.

A. Production of a Vector Encoding FokI-Cascade RNP Components to be Transfected into Target Cells Minimal CRISPR arrays were designed to target a set of loci in the human genome. Interspacer distances ranged from 23-34 bp, in increments of 1 bp. Eight targets were designed for each of the interspacer distances, and targets were flanked by AAG PAM sequences. Minimal CRISPR arrays were generated with PCR-based assembly (oligo-templated PCR amplification) using three oligonucleotides (SEQ ID NO:1513 to SEQ ID NO:1515) and a unique primer encoding a "repeat-spacer-repeat-spacer-repeat" sequence to enable FokI-Cascade targeting. The full set of unique oligonucleotide sequences to generate the minimal CRISPR arrays were SEQ ID NO:1516 to SEQ ID NO:1704. PCR-assembled guides were purified and concentrated using SPRIselect® (Beckman Coulter, Pasadena, CA) beads essentially according to the manufacturer's instructions.

FokI-Cascade RNP subunit protein component-encoding genes were cloned into vectors comprising: CMV promoters to enable delivery and expression in mammalian cells, cas genes linked via 2A "ribosome-skipping" sequences, and FokI attached to Cas8 with a 30-aa linker (SEQ ID NO:1748). Additional linker polypeptide sequences of varying length were designed and used to connect FokI to the Cas8 protein to form fusion proteins. The linker polypeptide sequences are listed in Table 45.

TABLE 45

Amino Acid Linker Sequences

| Linker length (amino acids) | Amino acid sequence | SEQ ID NO: |
|---|---|---|
| 17 | ADPTNRAKGLEAVSVAS | SEQ ID NO: 821 |
| 20 | SGSETPGTSESATPESGGSG | SEQ ID NO: 822 |

B. Transfection of Vectors Encoding FokI-Cascade RNP Complex Components

Transfection conditions were performed essentially as described in Example 8B except for with the following modifications. Prior to nucleofection, 5 µl of plasmid vector solution was transferred to individual wells of a 96-well plate. Each well contained 5 µg of plasmid encoding FokI-Cascade RNP protein components and ~0.1-0.5 µg of linear PCR product encoding the minimal CRISPR array.

C. Deep Sequencing of gDNA from Transfected Cells

Deep sequencing was performed essentially as described in Example 8C. Instead of primers Y and Z from Table 36 of Example 8C, the target-specific primers were SEQ ID NO:1705 to SEQ ID NO:1803.

Figure 34:
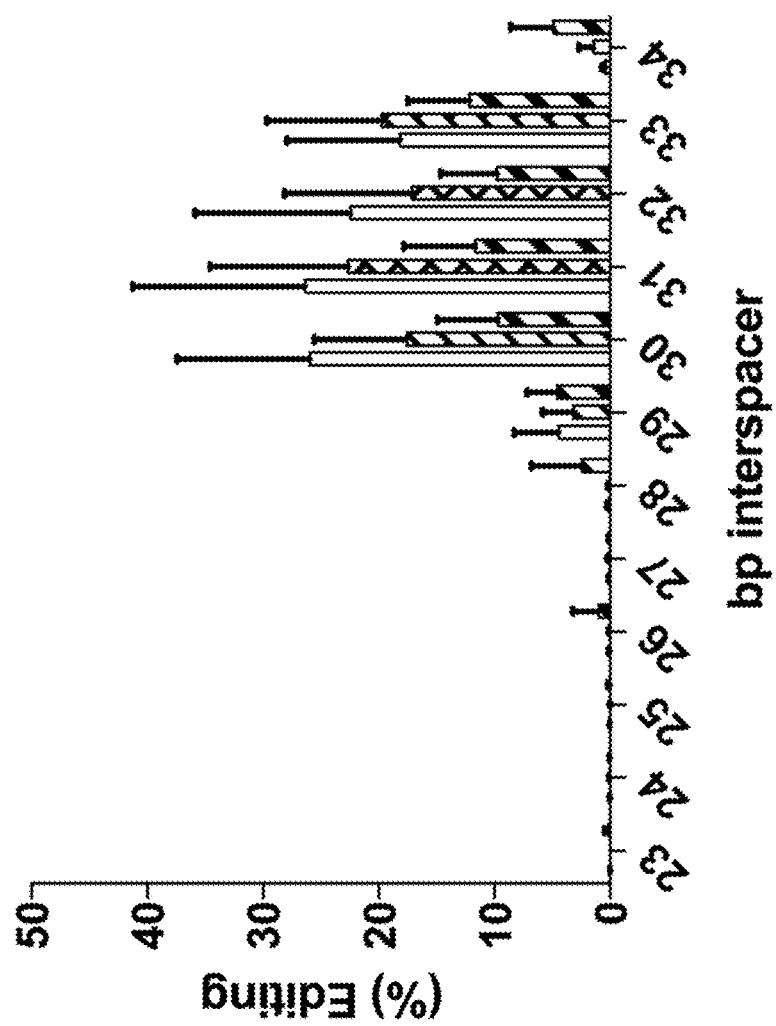

Deep sequencing data analysis was performed essentially as described in Example 8D. FIG. 34 shows genome editing (FIG. 34, vertical axis "% editing) at 95 sites (n=1). In FIG. 34, the horizontal axis corresponds to the interspacer length in base pairs (FIG. 34, bp interspacer). Linker lengths represented by the three bar graphs, from left to right, 17AA (FIG. 34, open bars), 20AA (FIG. 34, cross-hatch bars), and 30AA (FIG. 34, stripped bars). Editing ranged from ~50% (FIG. 34, error bars, shows the mean+/−1 s.d.) to below the limit of detection, and was related to the interspacer distance and linker polypeptide length. The amino acid composition of the linker polypeptides is discussed herein. Interspacer distances of ~30-33 bp and linker polypeptide lengths of 17 and 20 amino acids provided very efficient editing.

Figure 41A:
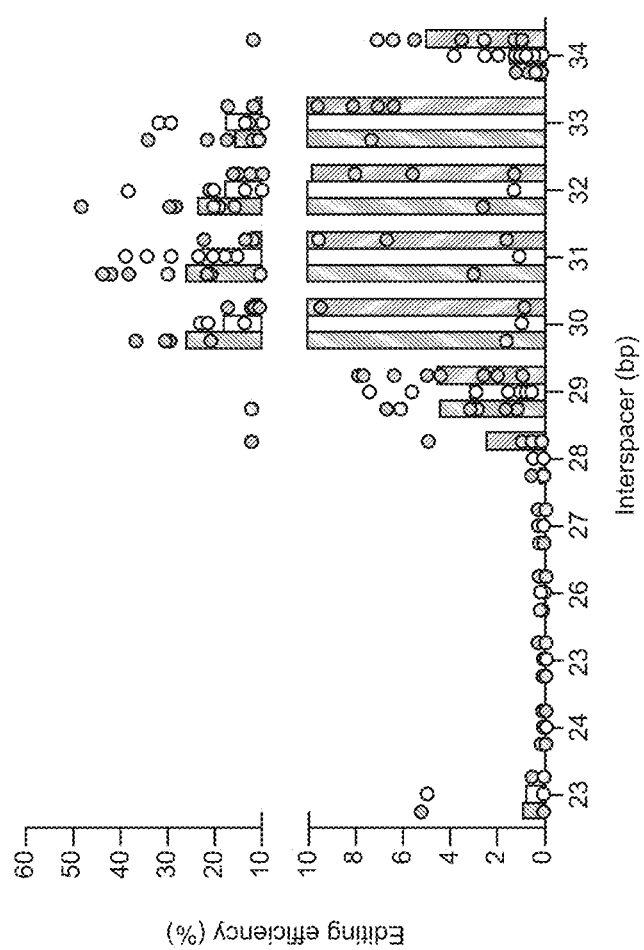
FIG. 41A, FIG. 41B, and FIG. 41C present data related to expanded screening of FokI-Cas8 linker length and interspacer distance for three Cascade homolog variants.
Figure 41B:
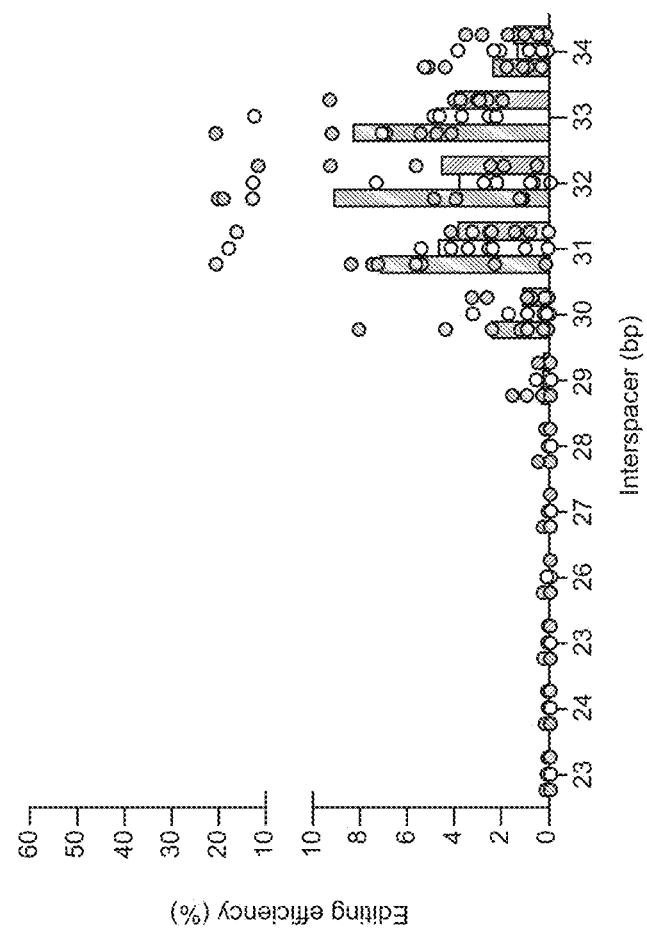
Figure 41C:
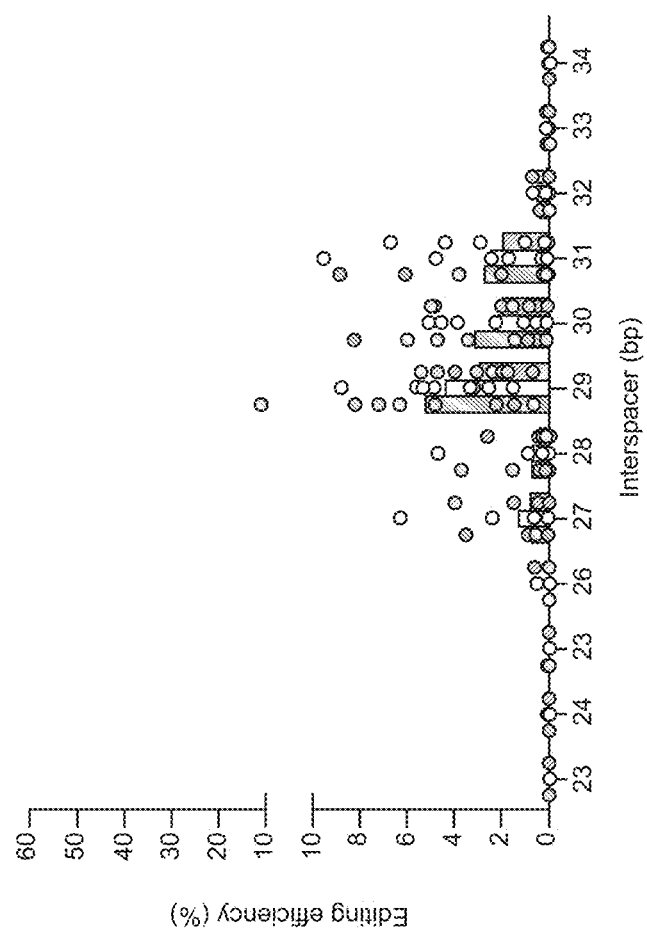

Data from additional experiments, following essentially the same protocol as set forth in this example, performed in support of the present invention are presented in FIG. 41A, FIG. 41B, and FIG. 41C. In these figures, the vertical axes are editing efficiency (%), and the horizontal axes are interspacer distance in bp (23-34 bp).The data expanded screening of FokI-Cas8 linker length and interspacer distance for three Cascade homolog variants, FokI-PseCascade (FIG. 41A), FokI-EcoCascade (FIG. 41B), and FokI-SthCascade (FIG. 41C). The percent editing efficiency is represented as a function of FokI-Cas8 linker length of 17 aa, 20 aa, and 30 aa (FIG. 41A, FIG. 41B, and FIG. 41C: left to right, 17 aa, 20 aa, and 30 aa) and interspacer distance. Each dot represents a single genomic site, and 7-8 sites were tested per interspacer distance. The means are shown in bar graphs. As can be seen from these data, interspacer distances of ~30-33 bp and linker polypeptide lengths of 17, 20, and 30 amino acids provided efficient editing for FokI-PseCascade, interspacer distances of ~31-33 bp and linker polypeptide lengths of 17, 20, and 30 amino acids provided efficient editing for FokI-EcoCascade, and interspacer distances of ~29-31 bp and linker polypeptide lengths of 17, 20, and 30 amino acids provided efficient editing for FokI-SthCascade.

Example 21

Utilizing Cas3-FokI and FokI-Cas8 to Enable FokI-Cascade Genome Editing

Figure 16A:
Figure 16B:
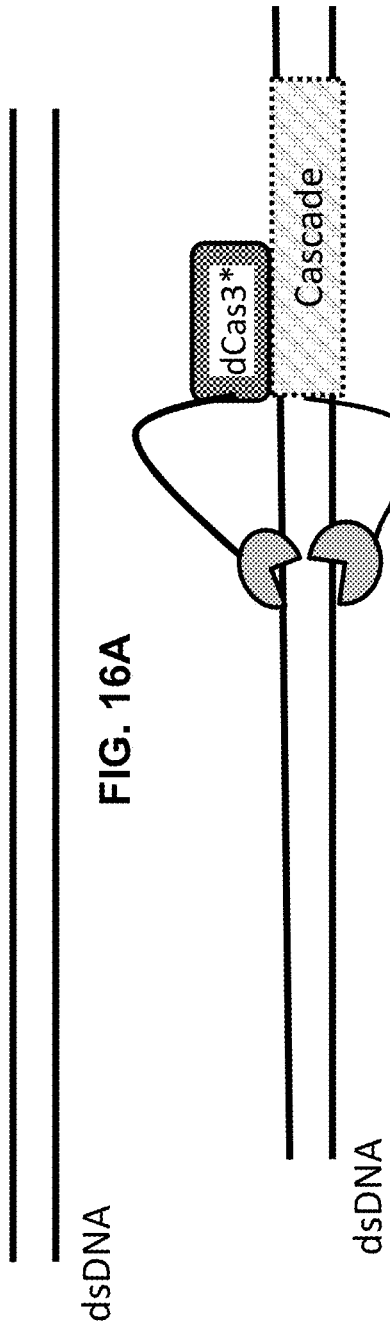
Figure 16C:
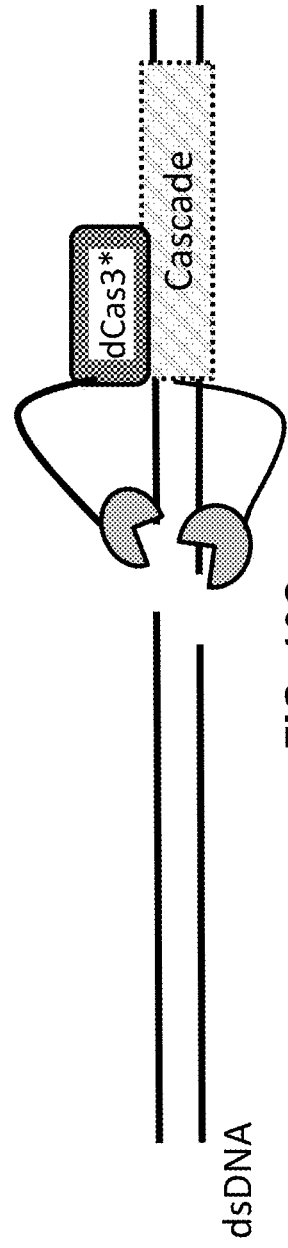

This Example illustrates the use of Cas3-FokI and FokI-Cascade to induce dimerization of FokI to generate a double-strand break at a locus in the human genome (see, e.g., FIG. 16A, FIG. 16B, and FIG. 16C). More specifically, this Example details the design and testing of multiple Cas3-FokI linker compositions and lengths and FokI-Cas8 linker compositions and lengths for affecting genome editing efficiency.

A. Production of a Vectors Encoding FokI-Cas3 and FokI-Cascade RNP Components to be Transfected into Target Cells Minimal CRISPR arrays are designed to target three distinct sites flanked by AAG PAMs in the human genome. ID NO:1806). Additional linkers sequences of varying length and composition are designed and used to connect FokI to the Cas3 protein (Table 46 and SEQ ID NO:1804 to SEQ ID NO:1807).

Additional Cas3-FokI fusion constructs are generated wherein the helicase or nuclease activity of the Cas3 protein is inactivated (SEQ ID NO:1808 to SEQ ID NO:1815). Helicase and nuclease activities are impaired by making D452A and D75A mutations, respectively, of the Cas3 protein (see, e.g., Mulepati, S., et al., J. Biol. Chem. 288: 22184-22192 (2013)).

TABLE 46

Amino Acid Linker Sequences

| Linker length (amino acids) | Amino acid sequence | SEQ ID NO: |
| --- | --- | --- |
| 5 | GGGGS | SEQ ID NO: 817 |
| 10 | GGSGSSGGSG | SEQ ID NO: 819 |
| 17 | ADPTNRAKGLEAVSVAS | SEQ ID NO: 821 |
| 20 | SGSETPGTSESATPESGGSG | SEQ ID NO: 822 |
| 40 | SGSETPGTSESATPESGGSGSSGGSGSSGG SGSSGGSGSS | SEQ ID NO: 823 |

Sites are selected that were previously shown to support interspacer editing with *E. coli* FokI-Cascade dimers directed by guides and are therefore known to be permissive for FokI-Cascade binding (e.g., Hsa37, Hsa43, and Hsa46).

The FokI-Cascade systems described in the Examples above used two FokI Cascade complexes (see, e.g., FIG. 15A, FIG. 15B, and FIG. 15C); accordingly, a first guide sequence specifying a first nucleic acid target site and a second guide sequence specifying a second nucleic acid target site can be used. Because the Cas3-FokI-FokI-Cascade system only requires a single PAM, a guide comprising "repeat-spacer-repeat" should be sufficient to facilitate binding of the functional Cascade complex to a nucleic acid target site. A polynucleotide containing "repeat-spacer-repeat-spacer-repeats" can also be used but, typically in this embodiment, the two spacer sequences direct binding of the Cascade complex to the same nucleic acid target sequence; that is, the two spacers can have the same sequence. The guides are cloned essentially as described in Example 9A with SEQ ID No:454. The following annealed oligonucleotides are used for generation of the minimal CRISPR arrays: Hsa37 (SEQ ID NO:1019; SEQ ID NO:1076), Hsa43 (SEQ ID NO:1024; SEQ ID NO:1081), and Hsa46 (SEQ ID NO:1027; SEQ ID NO:1084).

As described in Example 9A, FokI-Cascade RNP protein component-encoding genes are cloned into plasmid vectors containing CMV promoters to enable delivery and expression in mammalian cells. cas genes are linked via 2A "ribosome-skipping" sequences. Furthermore, FokI is fused to Cas8 with a 30-aa linker (SEQ ID NO:455). Additional linkers sequences of varying length and composition are designed and used to connect FokI to the Cas8 protein. Example of such sequences are listed in Table 46.

Cas3 protein from *E. coli* is fused with FokI on the C-terminus using a 30-aa linker. This fusion is further engineered with an NLS sequence on the N-terminus (SEQ B. Transfection of Plasmids Encoding FokI-Cascade RNP Complexes Transfection conditions are performed as described in Example 8B with the following modifications. Prior to nucleofection, 5 μl of plasmid vector solution are transferred to individual wells of a 96-well plate. Each well comprises the following three components: 3 μg of a plasmid encoding a set of FokI-Cascade RNP protein components, 3 μg of a plasmid encoding a Cas3-FokI, and 0.5 μg of a plasmid encoding a minimal CRISPR array. The 96-well plate is set up as a matrix to provide all combinations of the three components.

C. Deep Sequencing of gDNA from Transfected Cells

Deep sequencing is performed as described in Example 8C with the following modifications. Instead of primers Y and Z from Table 36 of Example 8C, the target-specific primers used in this Example are as follows: SEQ ID NO:1133 and SEQ ID NO:1190 (Hsa37 target site), SEQ ID NO:1138 and SEQ ID NO:1195 (Hsa43 target site), and SEQ ID NO:1141 and SEQ ID NO:1198 (Hsa46 target site).

D. Deep Sequencing Data Analysis

Deep sequencing data analysis is performed as described in Example 8D with the exception that indels ~1 bp to ~25 bp upstream of the FokI-Cascade binding site PAM sequence are tallied. In this manner, the combinations of FokI-Cas8 linker sequences, Cas3-FokI linker sequences, and Cas3 variants that support the most efficient editing can be determined.

Example 22

Screening Engineered Homolog FokI-Cascade Complexes

This Example illustrates the design and testing of multiple, homologous Cascade complexes with differing numbers of subunits to evaluate the efficiency of genome editing. The Example extends the analysis described in Example 19.

A. Production of DNA Template Components to be Transfected into Target Cells for FokI-Cascade RNP Complexes Minimal CRISPR arrays were designed to target two FokI-Cascade RNP complexes to adjacent loci on opposite strands of gDNA in the human genome. FokI-Cascade constructs were derived from each of eleven homologous species containing either three or four genes: *F. nucleatum* (Fnu, Type I-B), *C. fetus* (Cfe, Type I-B), *O. splanchnicus* (Osp, Type I-B), *B. halodurans* (Bhe, Type I-C), *D. vulgaris* (Dvu, Type I-C), *V. cholera* strain L15 (Vch, Type I-F), *K. oxytoca* (Koh, Type I-F), *P. aeruginosa* (Pae, Type I-F), *S. putrefaciens* (Spu, I-Fv2), *Acinetobacter* (Aci, Type I-Fv2), *V. cholerae* strain HE48 (Vch_v2, Type I-Fv2).

First and second engineered Class 1 Type I CRISPR-Cas effector complexes were designed wherein the first guide polynucleotide comprised a first spacer capable of binding a first nucleic acid target sequence, the second guide polynucleotide comprised a second spacer capable of binding a second nucleic acid target sequence, and a PAM of the first nucleic acid target sequence and the PAM of the second nucleic acid target sequence had an interspacer distance between 14 base pairs and 60 base pairs. The two engineered Class 1 Type I CRISPR-Cas effector complexes were oriented such that the PAMs were facing inward (i.e., a PAM-in orientation) relative to the guide RNA target sequence. PAM sequences were TCA for Type I-B, TTC for Type I-C, and CC for Type I-F, I-Fv2 (Type I-F and Type I-Fv2 have different repeat sequences in the CRISPR arrays; see Table 47 and Table 44).

TABLE 47

Additional Homolog Cascade Complexes

| SEQ ID NO: | Cascade homolog organism | PAM | Spacer length | Type |
|---|---|---|---|---|
| SEQ ID NO: 1816 | *Fusobacterium nucleatum* subsp. *animalis* 3_1_33 | TCA | 36 | I-B |
| SEQ ID NO: 1817 | *Klebsiella oxytoca* strain ICU1-2b contig 23 | CC | 32 | I-F |

Minimal CRISPR arrays were generated with PCR-based, oligo-templated assembly essentially as described herein (e.g., Example 20A; also FIG. 42A and FIG. 42B) using three oligonucleotides and a unique primer encoding a "repeat-spacer-repeat-spacer-repeat" sequence to enable FokI-Cascade RNP complex targeting. For Type I-B and Type 1-C a non-universal reverse oligonucleotide primer was used. PCR-assembled minimal CRISPR arrays were purified and concentrated using SPRIselect® beads (Beckman Coulter, Pasadena, CA) essentially as described in Example 20A.

In the engineered Class 1 Type I CRISPR-Cas effector complexes, FokI coding sequences were fused to the N-terminus of Cas8 for Type I-B, I-C, I-F complexes and to the N-terminus of Cas5 for Type I-Fv2 complexes. FokI-Cascade RNP protein component-encoding genes were cloned into vectors (see Table 44 and Table 47) comprising the following: CMV promoters to enable delivery and expression in mammalian cells, cas genes linked via 2A "ribosome-skipping" sequences, and a FokI monomer attached to Cas8 with a 30-aa linker (or Cas5 with a 30-aa linker in the case of the Type I-Fv2 homologs).

B. Transfection of Vectors Encoding Engineered FokI-Cascade RNP Complex Components Transfection conditions were performed essentially as described in Example 8B with the following modifications. Prior to nucleofection, 5 μL of a solution containing DNA templates was transferred to individual wells of a 96-well plate, wherein wells contained about 1.5 μg of each plasmid-encoding the components of the homologous FokI-Cascade complexes as well as 0.4 μg of linear PCR product encoding the minimal CRISPR array.

C. Deep Sequencing of gDNA from Transfected Cells

Figure 43:
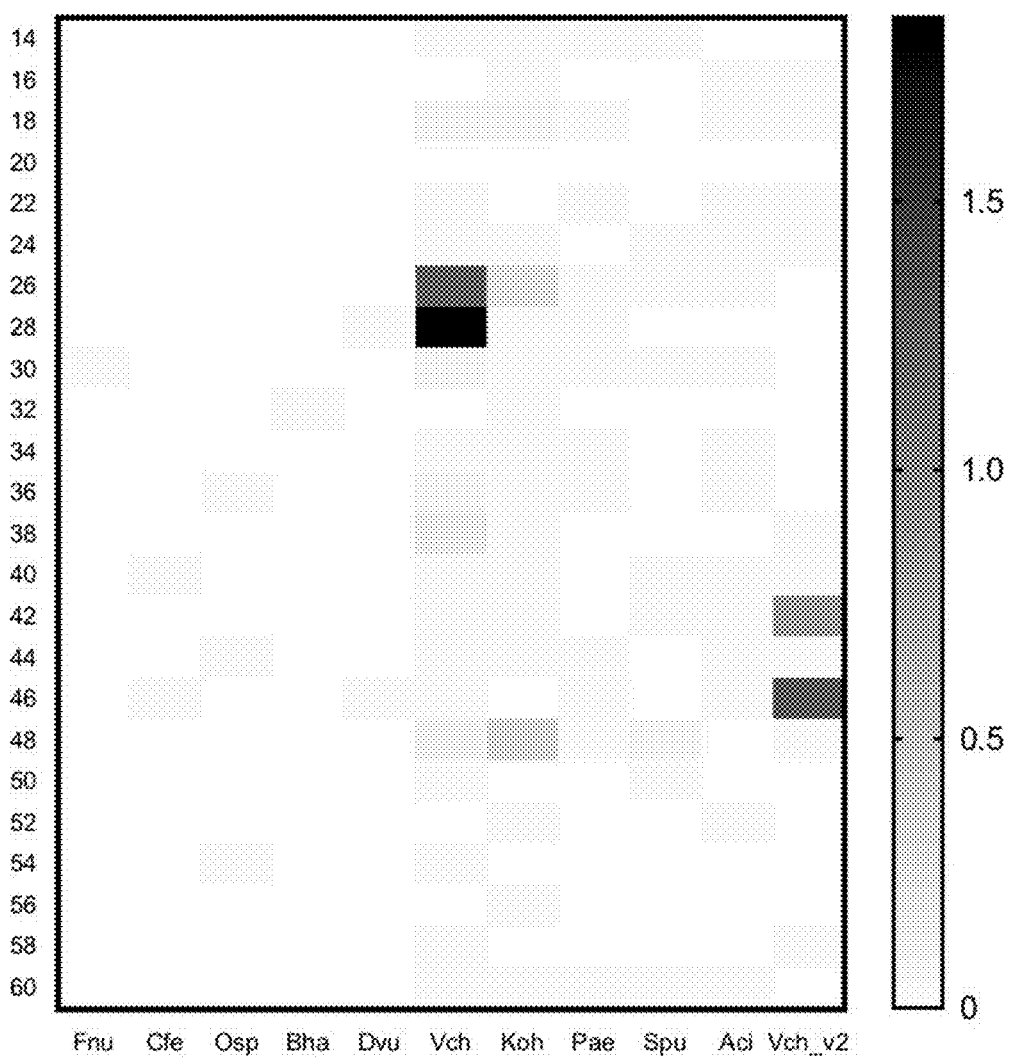
FIG. 43 presents data for percent genome editing is shown as a function of FokI-Cascade homolog variant and interspacer distance.

Deep sequencing was performed essentially as described in Example 8C. However, instead of primers Y and Z from Table 36 of Example 8C, different target-specific primers were used. FIG. 43 presents the results of the data analysis. In FIG. 43, percent genome editing is shown as a function of FokI-Cascade homolog variant (FIG. 43, horizontal axis, the eleven homolog variants are identified by the abbreviations set forth above, and occur in the same order on the horizontal axis) and interspacer distance (FIG. 43, vertical axis, 14-60 bp); the grey scale vertical bar to the right is percentage of indels. Each measurement at a given interspacer distance represents the average editing across 4 target sites (n=1 per target site). Editing with most of the engineered FokI-Cascade ortholog complexes was below the limit of detection across the tested target sites, whereas editing with engineered *Vibrio cholera* strain L15 (Type I-F) FokI-Cascade complexes ranged from below the limit of detection up to ~2% indels, with the highest editing observed with interspacer distances of between 26 bp and 28 bp. Editing was also observed with engineered *Vibrio cholera* strain HE48 (Type I-Fv2) FokI-Cascade complexes from, ranging from below the limit of detection to ~1.5% with interspacer distances of between 42 bp and 46 bp.

The data in this Example illustrate that the methods described herein can be effectively applied to identify homologous Cascade complexes that are efficacious for genome editing.

Example 23

Using mCas3 Proteins to Restrict Deletion Lengths in Cells

This Example illustrates how to mutate a Cas3 protein, such that the resulting Cas3-induced deletions are shorter relative to those generated with wtCas3 protein, for use in genome editing (e.g., in human cells).

A. Production of Cascade and Cas3 DNA Template Components

A minimal CRISPR array was designed to target *E. coli* Cascade (EcoCascade) RNP complex to a genomic locus with an AAG PAM on chr2 (HZGJ gene) in the human genome. Next, the minimal CRISPR array was generated with PCR-based assembly using three oligonucleotides (SEQ ID NO:1513 to SEQ ID NO:1515; Example 20A) and a unique primer encoding a "repeat-spacer-repeat-spacer-repeat" sequence to enable EcoCascade RNP targeting (SEQ ID NO:1818). The resulting amplicon contains an hu6 promoter driving expression of the minimal CRISPR array. For this minimal CRISPR array, identical sequences were used for both spacer sequences. PCR-assembled minimal CRISPR arrays were purified and concentrated using SPRIselect® beads (Beckman Coulter, Pasadena, CA).

A panel of *E. coli* Cas3 (EcoCas3) mutant variants were designed in order to decrease DNA translocation processivity (i.e., movement along the length the DNA) of the mutant proteins on DNA while maintaining DNA nuclease activity.

Referencing the crystal structures of *Thermobifida fusca* Cas3 bound to single-stranded DNA substrate (Huo, Y., et. al., Nat. Struct. Mol. Biol. (9):771-777 (2014)), locations of functional protein domains, and homology with other Cas3 orthologs, a set of 24 distinct mutations in EcoCas3 (*E. coli* (P38036) Cas3 amino acid sequence: UniProtKB-P38036 (CAS3_ECOLI)) were made to modulate either the ATP binding/hydrolysis region in the helicase domain (i.e., G317A, S318A, G319A, K320N, T321N, Q297E, D452E, E453N, R662A, R665Q) or ssDNA loop binding/ssDNA path conserved region of the helicase domain (i.e., T346A, Q347N, G375A, K412G, T423A, D425H, Q426T, H601A, A602V, R603Q, R609S, T635A, Q636A, Q640H). Table 48 lists the EcoCas3 wild-type protein and mutant proteins, plasmids encoding the sequences (nucleotide sequence), and corresponding amino acid sequences.

prior to nucleofection, 6 µL of solution containing DNA templates was transferred to individual wells of a 96-well plate—wells contained 3 µg of the plasmid-encoding Eco-Cascade complex proteins, 1 µg of plasmid-encoding wild-type or mutant EcoCas3 protein, and 0.2 µg of linear PCR product encoding the minimal CRISPR array. gDNA was harvested approximately 4 days after transfection.

C. Deep Sequencing of gDNA from Transfected Cells

Deep sequencing was performed essentially as described in Example 8C. However, instead of primers Y and Z from Table 36 of Example 8C, the target-specific primers were SEQ ID NO:1873 to SEQ ID NO:1874; also, a MiSeq reagent kit v3, 600 cycles (Illumina, San Diego, CA) was used. Deep sequencing data analysis was performed essentially as described in Example 8D with the following modifications: (1) unique read classes with at least one read and with a greater than 3 nucleotide deletion anywhere within the amplicon (amplicon location: chr2:68156987-68157510; length=524 nucleotides) window were tallied (herein referred to as "unique deletions classes"; classes were not weighted by read count, as amplification bias may influence read counts for products with long deletions), (2) read

TABLE 48

EcoCas3 Mutant Proteins

| Nucleotide Sequence SEQ ID NO: | Amino Acid Sequence SEQ ID NO: | EcoCas3 Protein Description | Mutation* | Affected Domain of Cas3 protein |
|---|---|---|---|---|
| 1819 | 1844 | WtCas3 | not applicable | not applicable |
| 1820 | 1845 | Cas3 mutation variant 1 | G317A | ATP binding/hydrolysis in helicase |
| 1821 | 1846 | Cas3 mutation variant 2 | S318A | ATP binding/hydrolysis in helicase |
| 1822 | 1847 | Cas3 mutation variant 3 | G319A | ATP binding/hydrolysis in helicase |
| 1823 | 1848 | Cas3 mutation variant 4 | K320N | ATP binding/hydrolysis in helicase |
| 1824 | 1849 | Cas3 mutation variant 5 | T321N | ATP binding/hydrolysis in helicase |
| 1825 | 1850 | Cas3 mutation variant 6 | Q297E | ATP binding/hydrolysis in helicase |
| 1826 | 1851 | Cas3 mutation variant 7 | D452E | ATP binding/hydrolysis in helicase |
| 1827 | 1852 | Cas3 mutation variant 8 | E453N | ATP binding/hydrolysis in helicase |
| 1828 | 1853 | Cas3 mutation variant 9 | R662A | ATP binding/hydrolysis in helicase |
| 1829 | 1854 | Cas3 mutation variant 10 | R665Q | ATP binding/hydrolysis in helicase |
| 1830 | 1855 | Cas3 mutation variant 11 | T346A | ssDNA path conserved region |
| 1831 | 1856 | Cas3 mutation variant 12 | Q347N | ssDNA path conserved region |
| 1832 | 1857 | Cas3 mutation variant 13 | G375A | ssDNA path conserved region |
| 1833 | 1858 | Cas3 mutation variant 14 | K412G | ssDNA path conserved region |
| 1834 | 1859 | Cas3 mutation variant 15 | T423A | ssDNA path conserved region |
| 1835 | 1860 | Cas3 mutation variant 16 | D425H | ssDNA path conserved region |
| 1836 | 1861 | Cas3 mutation variant 17 | Q426T | ssDNA path conserved region |
| 1837 | 1862 | Cas3 mutation variant 18 | H601A | ssDNA path conserved region |
| 1838 | 1863 | Cas3 mutation variant 19 | A602V | ssDNA path conserved region |
| 1839 | 1864 | Cas3 mutation variant 20 | R603Q | ssDNA path conserved region |
| 1840 | 1865 | Cas3 mutation variant 21 | R609S | ssDNA path conserved region |
| 1841 | 1866 | Cas3 mutation variant 22 | T635A | ssDNA path conserved region |
| 1842 | 1867 | Cas3 mutation variant 23 | Q636A | ssDNA path conserved region |
| 1843 | 1868 | Cas3 mutation variant 24 | Q640H | ssDNA path conserved region |

*Relative to wild-type EcoCas3 protein sequence

EcoCascade RNP protein component-encoding genes as well as wild-type (wt) and mutant EcoCas3 genes were cloned into vectors containing CMV promoters to enable delivery and expression in mammalian cells. The EcoCascade RNP cas genes were linked via 2A "ribosome-skipping" sequences and all genes contained N-terminal NLS sequences to direct the encoded proteins to the nucleus (EcoCascade polycistronic plasmid, nucleotide sequence SEQ ID NO:1871, polycistonic amino acid sequence 1872).

B. Transfection of Vectors Encoding Engineered EcoCascade RNP, Wild-Type EcoCas3 Protein, and Mutant EcoCas3 Proteins Transfection conditions were performed essentially as described in Example 8B, with the following modifications:

classes with insertions or multiple deletions were discarded, and (3) deletion start site and stop site were mapped compared between samples.

Figure 45A:
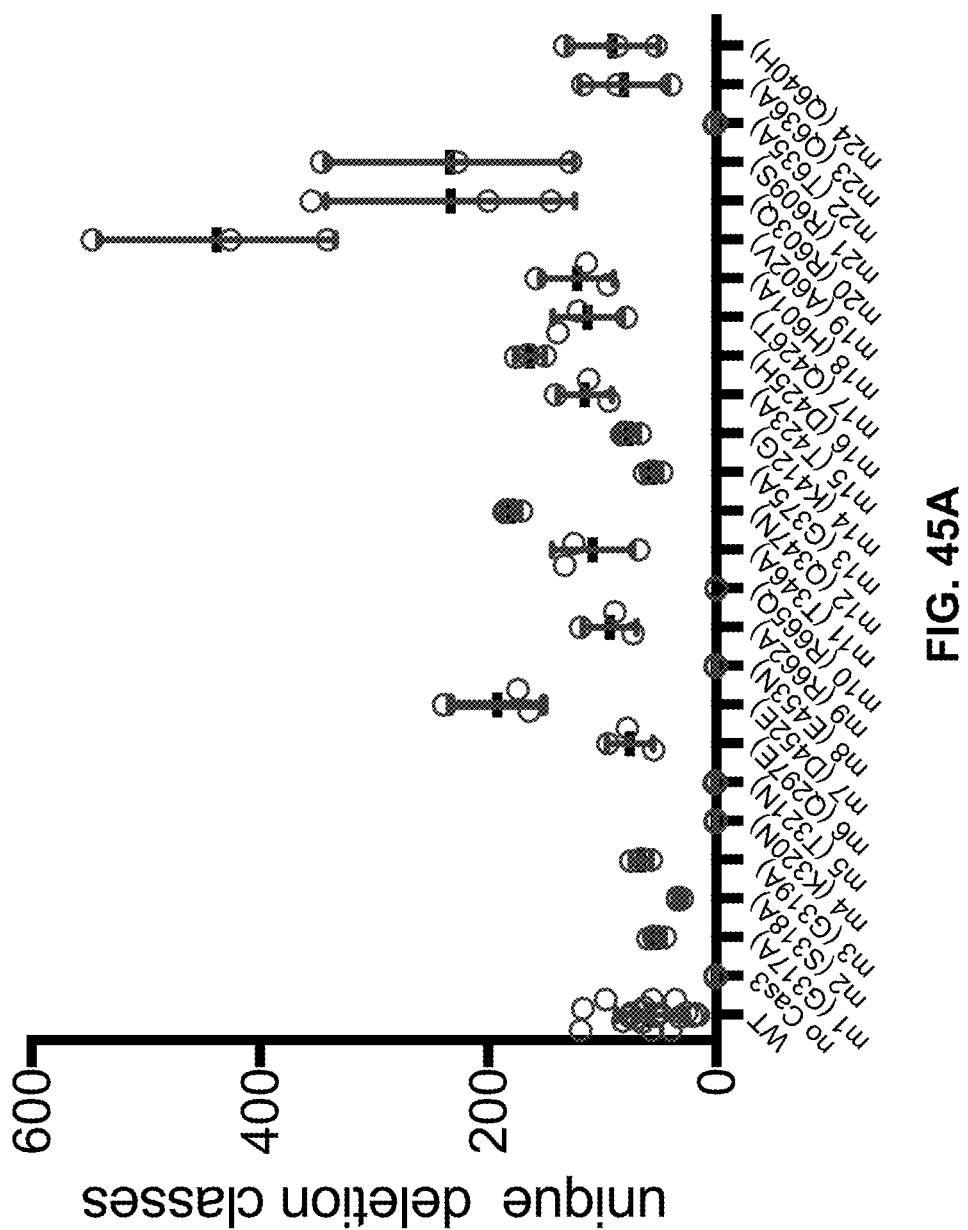
FIG. 45A, FIG. 45B, FIG. 45C, and FIG. 45D show data related to genome editing using EcoCascade RNP complexes comprising wild-type or mutant EcoCas3 proteins.
Figure 45B:
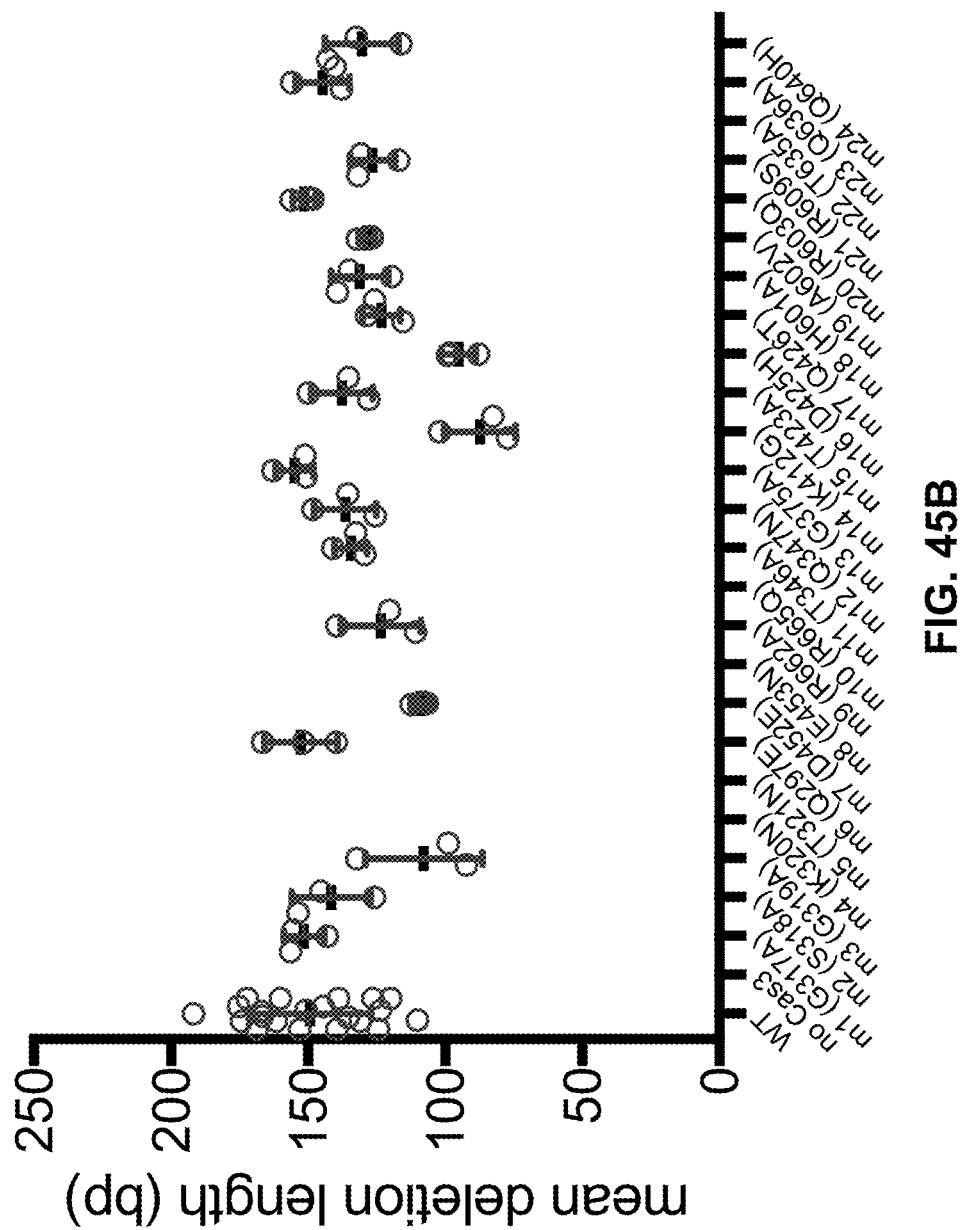
Figure 45C:
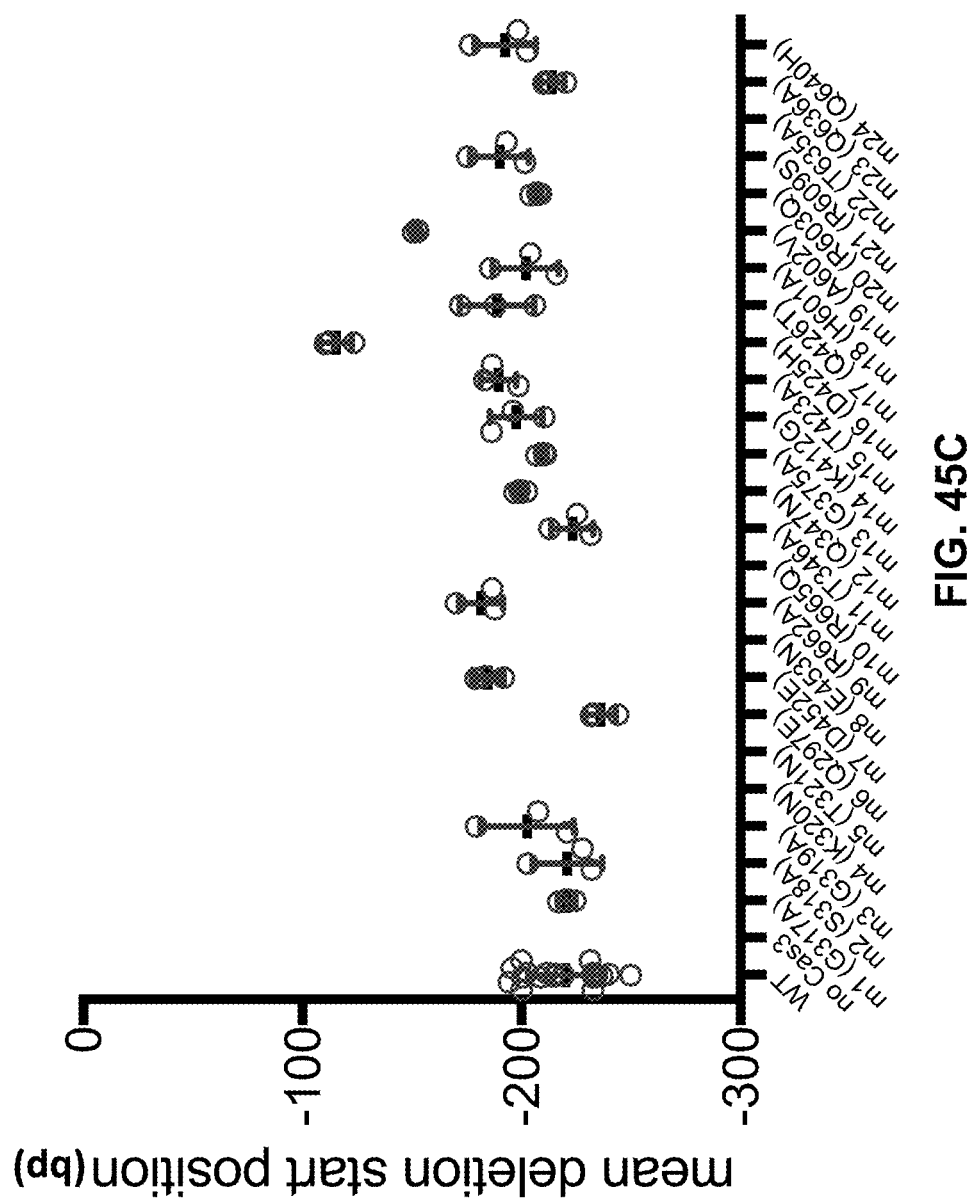
Figure 45D:
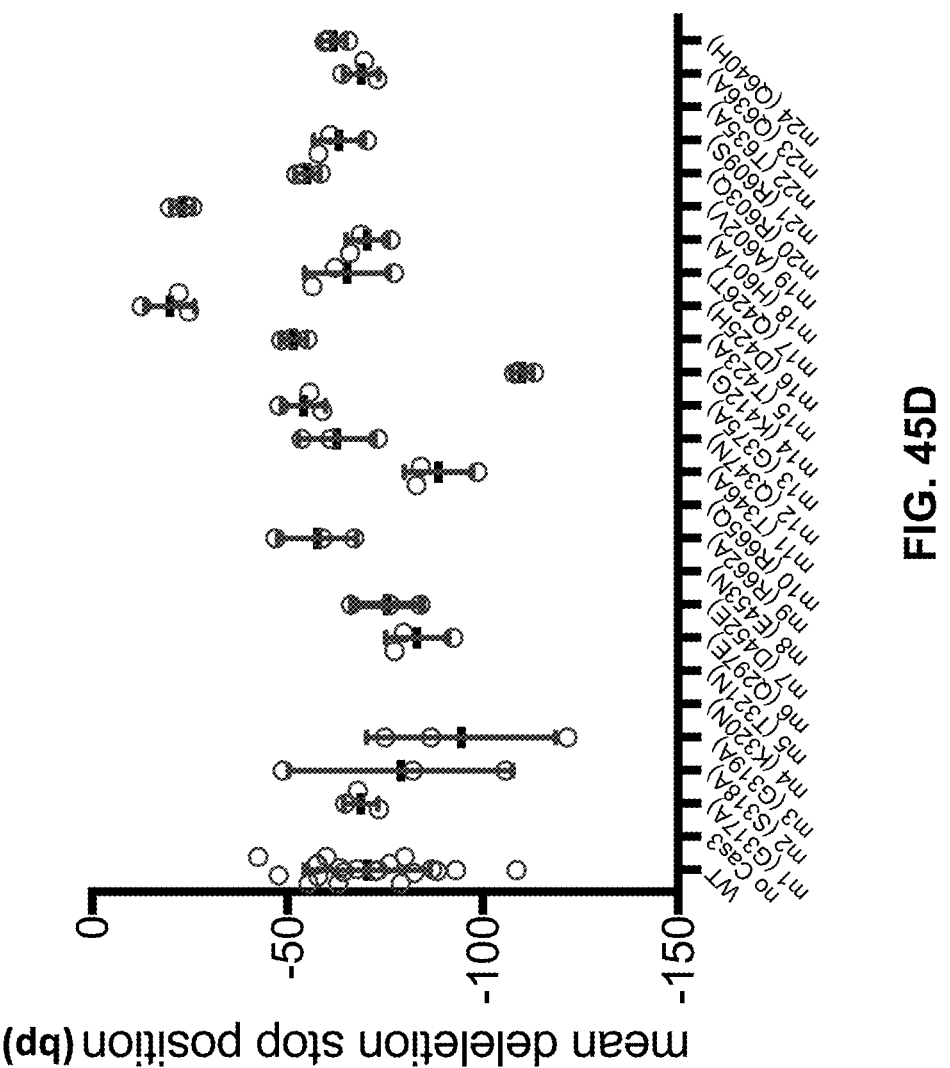

FIG. 45A, FIG. 45B, FIG. 45C, and FIG. 45D show genome editing at the HZGJ locus with EcoCascade RNP complexes comprising either wild-type EcoCas3 protein (n=21), lacking EcoCas3 protein (n=3), or mutant EcoCas3 protein (n=3). FIG. 45A shows the number of unique deletion classes on the vertical axis (FIG. 45A, 0 to 600) and the EcoCas3 protein variant on the horizontal axis (FIG. 45A, left to right, a wild-type control (WT), a no Cas3 protein control, and the m1Cas3 protein to m24Cas3protein in the order given in Table 48). Here, Cas3 mutant variants that resulted in increased numbers of unique deletion classes within the 524 bp amplicon window were candidates for reduced translocation processivity (i.e., movement along the length the DNA). FIG. 45B shows mean deletions lengths in base pairs on the vertical axis, and the EcoCas3 protein variant on the horizontal axis (same order as for FIG. 45A). As with the unique deletion classes measurement, Cas3 mutant variants that resulted in smaller deletion lengths within the 524 bp amplicon window were candidates for reduced translocation processivity. FIG. 45C shows mean deletions start position (bp) relative to a site 6 bp upstream of the EcoCascade PAM (i.e., near the Cas3 nicking site) on the vertical axis, and the EcoCas3 protein variant on the horizontal axis (same order as for FIG. 45A). FIG. 45D shows mean deletions stop position (bp) relative to a site 6 bp upstream of the EcoCascade PAM (i.e., near the expected Cas3 nicking site) on the vertical axis, and the EcoCas3 protein variant on the horizontal axis (same order as for FIG. 45A). Here, Cas3 mutants that showed deletion start and stop positions closer to the EcoCas3 expected nicking site were deemed strong candidates for reduced translocation processivity (i.e., movement along the length the DNA). Taken together, Cas3 mutants that showed some combination of increased unique deletions classes within the amplicon window, shorter deletion classes within the amplicon window, and position-shifted deletion classes within the amplicon window, were strong candidates for reduced translocation processivity.

Several mutants gave altered repair patterns indicative of reducing deletion lengths. Relative to wild-type EcoCas3 protein, mutant EcoCas3 proteins D452H and A602V both showed (1) a large increase in the number of unique deletion classes within the amplicon window, which can be indicative of shorter deletions, and (2) within the amplicon window, deletions shifted closer to the EcoCas3 initiation site relative to wild-type EcoCas3 protein, which also can be indicative of shorter deletions. Mutant EcoCas3 protein A602V also showed smaller deletions within the amplicon window, relative to wild-type EcoCas3 protein. Both mutations D452H and A602V have been predicted to impact the ssDNA loop binding. The data in this Example demonstrate that mutations can be introduced into the Cas3 protein to reduce deletion lengths relative to wtCas3 protein, in association with a Cascade RNP complex, when introduced into and expressed in human cells and provide guidance regarding how to make and use Cas3 proteins comprising mutations to modulate deletion lengths in gDNA in cells.

Example 24

Using Roadblocks to Limit Cas3-Induced Deletion Lengths

Several methods to limit and/or define the deletion length facilitated by Cascade RNP complexes associated with Cas3 protein are described in the present application. This Example illustrates how a protein roadblock can be used to limit Cas3 deletions.

A. Production of Cas3 Protein and EcoCascade RNP DNA Template Components

A minimal CRISPR array was designed to target *E. coli* Cascade (EcoCascade) RNP to a genomic locus with an AAG PAM on chr2 (HZGJ gene) in the human genome. Next, a minimal CRISPR array was generated with PCR-based assembly using three oligonucleotides (SEQ ID NO:1513 to SEQ ID NO:1515) and a primer encoding a "repeat-spacer-repeat-spacer-repeat" sequence to enable EcoCascade RNP targeting, essentially as described in Example 20A. For this minimal CRISPR array, both spacer sequences were identical. PCR-assembled guides were purified and concentrated using SPRIselect® (Beckman Coulter, Pasadena, CA) beads largely according to the manufacturer's instructions. Engineered EcoCascade protein component-encoding genes as well as *E. coli* Cas3 (EcoCas3) genes were cloned into vectors containing CMV promoters to enable delivery and expression in mammalian cells. The EcoCascade RNP cas genes were linked via 2A "ribosome-skipping" sequences (plasmid nucleotide sequence, SEQ ID NO:1871; polycistronic protein sequence, SEQ ID NO:1872) and all genes contained N-terminal NLS sequences to direct the encoded proteins to the nucleus.

B. Production of dCas9-VP64/sgRNA RNP Complexes sgRNA components of dCas9-VP64/sgRNA RNP complexes, wherein the complexes are to be used as roadblocks to stop the translocation processivity (i.e., movement along the DNA) of Cas3 protein associated with a Cascade RNP complex, were produced by in vitro transcription (T7 Quick High Yield RNA Synthesis Kit, New England Biolabs, Ipswich, MA). PCR using 5' overlapping primers was used to assemble the dsDNA templates for transcription of sgRNA components. The dsDNA templates incorporated a T7 promoter at the 5' end of the DNA sequence. The components, templates, and primers used to produce sgRNA templates are set forth in Table 49.

TABLE 49

| SEQ ID NO: | Description | Sequence |
|---|---|---|
| | sgRNA DNA Template Oligonucleotides | |
| 1887 | sgRNA templating forward | AGTAATAATACGACTCACTATAG |
| 1888 | sgRNA templating oligo reverse | AAAAAAGCACCGACTCGGTGCCACTTTTTCAAG TTGATAACGGACTAGCCTTATTTTAACTTGCTAT TTCTAGCTCTAAAAC |
| 1889 | Roadblock F1 | TAATACGACTCACTATAGTGGATATGGGCGATG ATCTGGTTTTAGAGCTAGAAATAGC |
| 1890 | Roadblock F2 | TAATACGACTCACTATAGGTTGAAGCCCTTCTGG ATATGTTTTAGAGCTAGAAATAGC |
| 1891 | Roadblock F3 | TAATACGACTCACTATAGAGTTGAAGCCCTTCTG GATAGTTTTAGAGCTAGAAATAGC |

TABLE 49-continued sgRNA DNA Template Oligonucleotides

| SEQ ID NO: | Description | Sequence |
|---|---|---|
| 1892 | Roadblock F4 | TAATACGACTCACTATAGCCGTGTAGTTGAAGC CCTTCGTTTTAGAGCTAGAAATAGC |
| 1893 | Roadblock F5 | TAATACGACTCACTATAGGTCACAAATTTGGCG CTGCAGTTTTAGAGCTAGAAATAGC |
| 1894 | Roadblock F6 | TAATACGACTCACTATAGCTCGTACAGCTGAAT GACGCGTTTTAGAGCTAGAAATAGC |
| 1895 | Roadblock R1 | TAATACGACTCACTATAGGATCATCGCCCATATC CAGAGTTTTAGAGCTAGAAATAGC |
| 1896 | Roadblock R2 | TAATACGACTCACTATAGATCATCGCCCATATCC AGAAGTTTTAGAGCTAGAAATAGC |
| 1897 | Roadblock R3 | TAATACGACTCACTATAGCCAGAAGGGCTTCAA CTACAGTTTTAGAGCTAGAAATAGC |
| 1898 | Roadblock R4 | TAATACGACTCACTATAGACACGGTGTTTGACTG TAAGGTTTTAGAGCTAGAAATAGC |
| 1899 | Roadblock R5 | TAATACGACTCACTATAGCAGCGCCAAATTTGT GACCAGTTTTAGAGCTAGAAATAGC |

The PCR reaction to assemble the sgRNA DNA template was carried out as follows with a reaction mix comprising: one "internal" DNA primer (SEQ ID NO:1889 to SEQ ID NO:1899) at a concentration of 40 nM, two "outer" DNA primers (SEQ ID NO:1887 and SEQ ID NO:1888; containing the T7 promoter and the 3' end of the RNA sequence) at a concentration of 500 nM. PCR reactions were performed using Q5 Hot Start High-Fidelity 2× Master Mix (New England Biolabs, Ipswich, MA) essentially following the manufacturer's instructions. PCR assembly reactions were carried out using the following thermal cycling conditions: 98° C. for 2 minutes, 11 cycles of 10 seconds at 98° C., 20 seconds at 58° C., 20 seconds at 72° C., and a final extension at 72° C. for 1 min.

Between approximately 0.25-0.5 µg of each sgRNA DNA template was transcribed using T7 High Yield RNA Synthesis Kit (New England Biolabs, Ipswich, MA) for approximately 16 hours at 37° C. Transcription reactions were DNAse I-treated (New England Biolabs, Ipswich, MA). The dCas9 protein (D10A & H840A; see, e.g., Sander, J. D., et al., Nat. Biotechnol. 32: 347-355 (2014)) having the VP64 effector domain fused to the C-terminus, and an NLS tag was appended on the C-terminus of VP64 (N-NLS-VP64 coding sequence-dCas9 coding sequence-C), was expressed from bacterial expression vectors in E. coli (BL21 (DE3)) and purified using affinity chromatography, ion exchange chromatography (IEC), and size exclusion chromatography (SEC) essentially as described by Jinek, M., et al., Science 337:816-821 (2012).

C. Transfection of Vectors Encoding EcoCas3 and Components of the EcoCascade RNP Complex Components, as Well as dCas9-VP64/sgRNA RNP Complexes Transfection of HEK293 cells was performed essentially as described in Example 8B with the following modifications:

for Cas3/EcoCascade RNP complex formation, 4 µL of a solution containing DNA templates encoding EcoCas3 protein and EcoCascade proteins was transferred to individual wells of a 96-well plate wherein said wells contained either 3 µg of plasmid-encoding EcoCascade proteins, 0.2 µg of linear PCR product encoding the minimal CRISPR array, and 0, 1, or 3 µg of plasmid encoding EcoCas3; and for Cas3-EcoCascade RNP complex formation, 3 µg of plasmid-encoding Cas3-EcoCascade protein components wherein the Cas3 was linked to the Cas8 protein with a 17-aa linker, and 0.2 µg of linear PCR product encoding the minimal CRISPR array.

Next, the dCas9-VP64/sgRNA RNP complexes were assembled. Specifically, sgRNAs were incubated for 2 minutes at 95° C. then allowed to equilibrate to room temperature for about 5 minutes. dCas9-VP64 protein was mixed with sgRNA in reaction buffer (20 mM HEPES, pH 7.5, 100 mM KCL, 5 mM MgCl2, 5% glycerol) at a 1:3 ratio for 10 minutes at 37° C. The assembled dCas9-VP64/sgRNA RNP complexes were transferred into the wells of the 96-well plate at varying doses for transfection into the cells, establishing a matrix wherein each Cas3/EcoCascade or Cas3-EcoCascade mixture received either 0, 5, 20, or 50 pmol of dCas9-VP64 roadblock. gDNA was harvested from the cells 4 days after nucleofection.

D. Deep Sequencing of gDNA from Transfected Cells

Figure 46A:
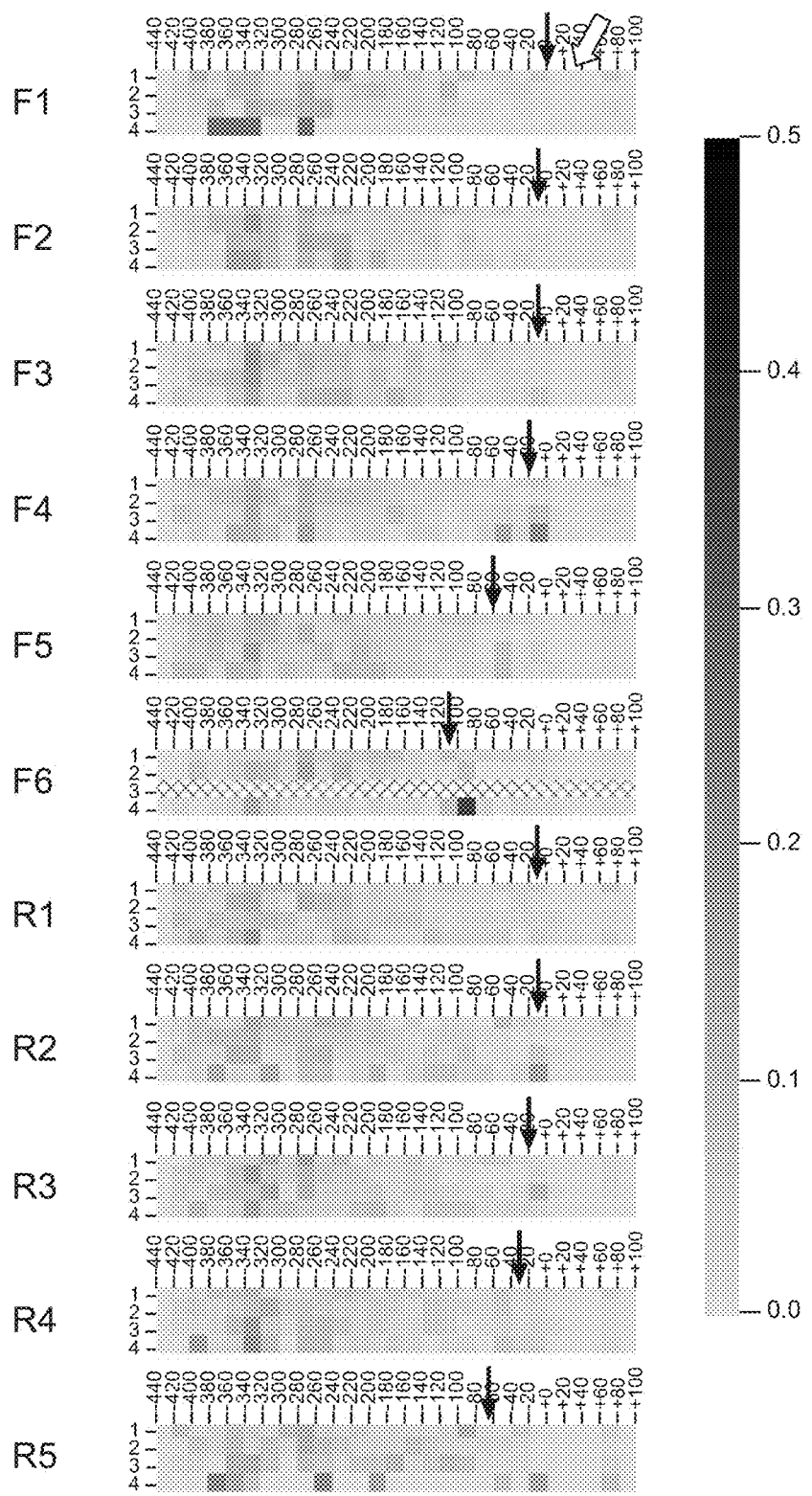
FIG. 46A, FIG. 46B, FIG. 46C, FIG. 47A, and FIG. 47B present data related to dCas9-VP64/sgRNA RNP complex roadblocks and their effect on cleavage of targets by EcoCascade RNP complexes.
Figure 46B:
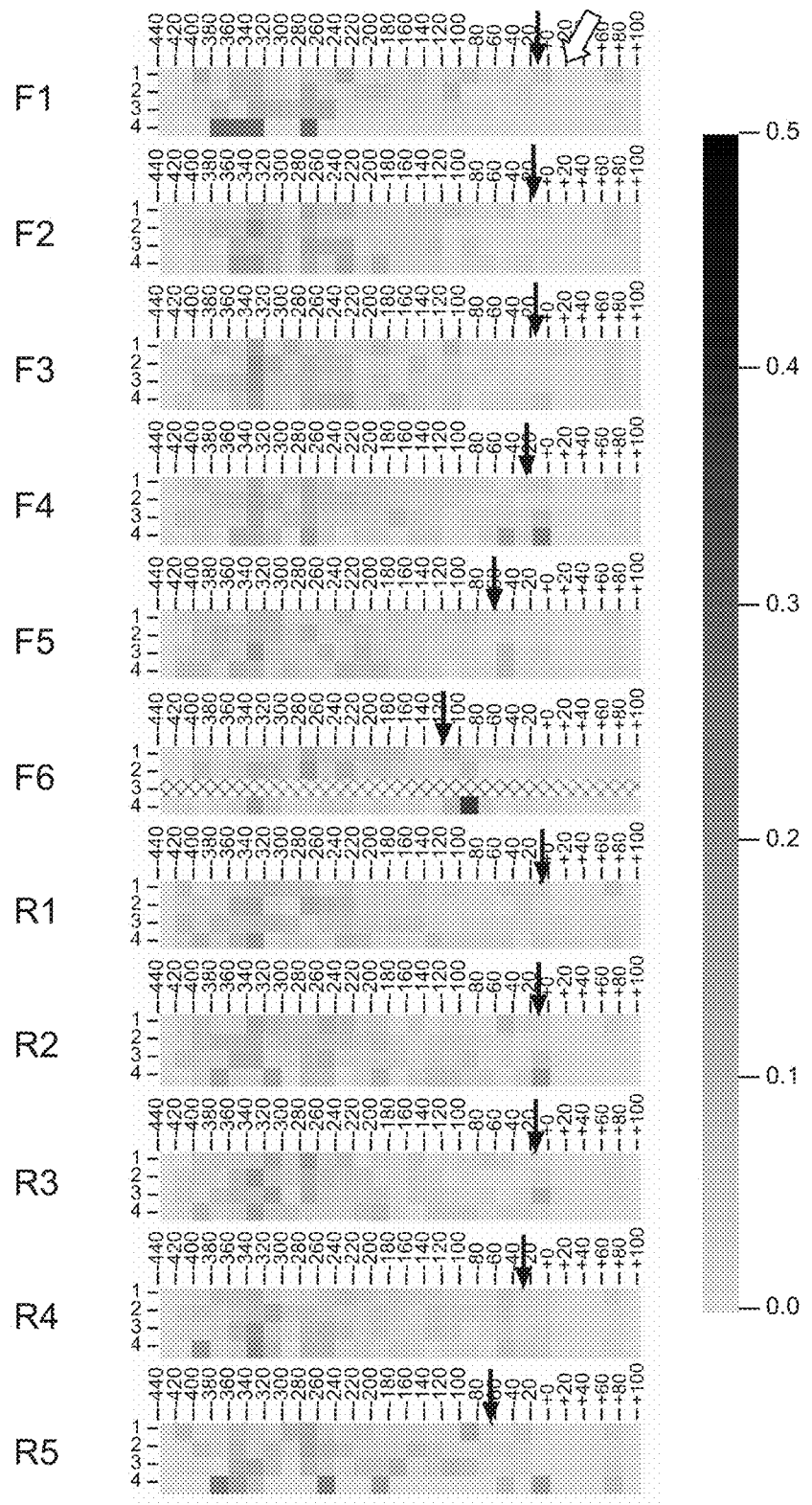
Figure 46C:
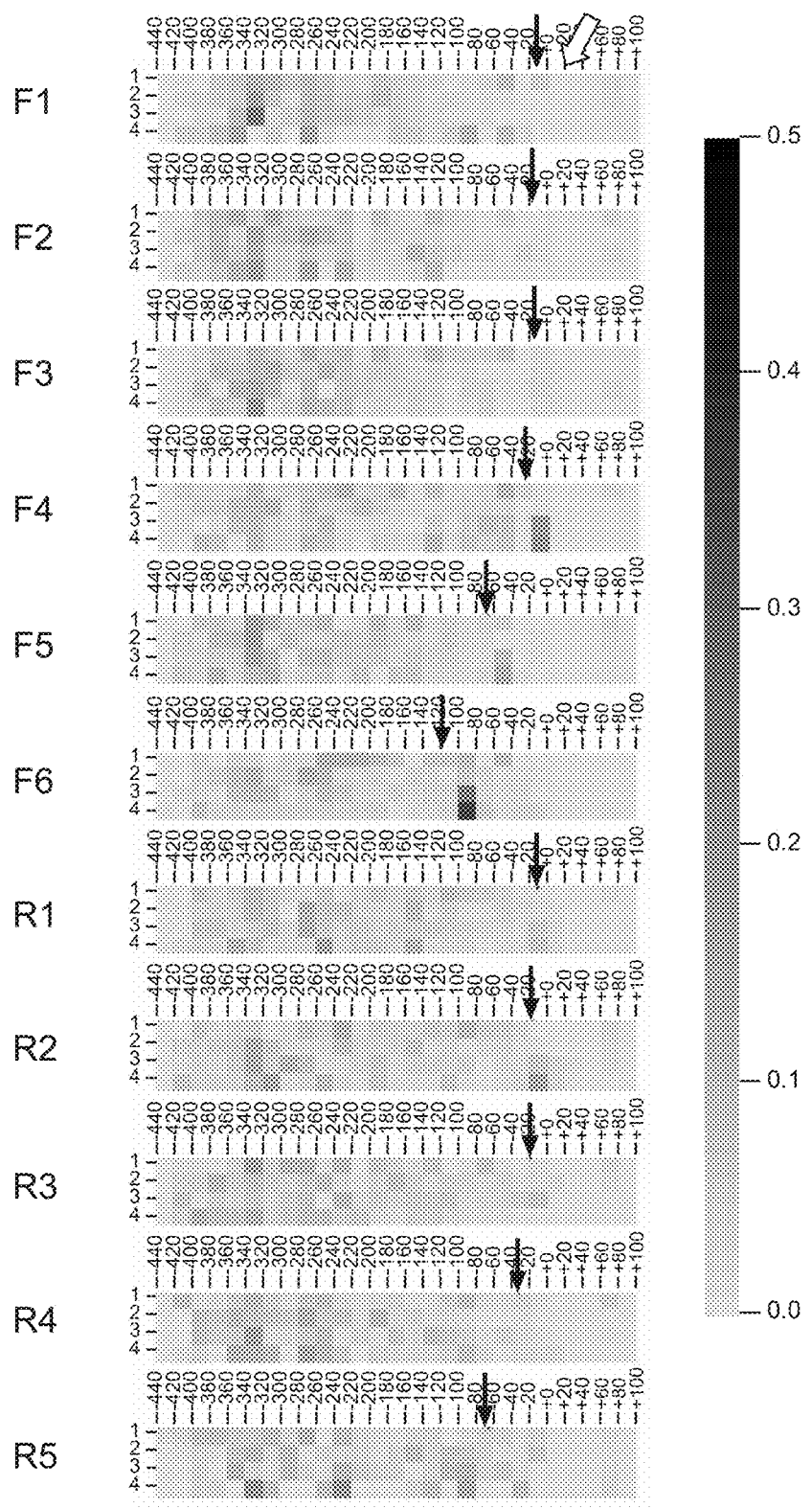

Deep sequencing and data analysis were performed essentially as described in Example 23C. FIG. 46A, FIG. 46B, and FIG. 46C present a series of heat maps demonstrating the frequency of deletion start sites at the HZGJ locus (FIG. 46A, FIG. 46B, and FIG. 46C, open arrows indicate the expected Cas3 nicking site) in relation to the location to which the indicated dCas9-VP64/sgRNA RNP complexes were targeted to bind (i.e., the location of the roadblock, FIG. 46A, FIG. 46B, FIG. 46C, black arrows), for either Cas3/EcoCascade (with 1 µg or 3 µg of Cas3-expressing plasmid, FIG. 46A and FIG. 46B, respectively) or Cas3-EcoCascade (FIG. 46C) in the absence or presence of the dCas9-VP64/sgRNA RNP complex roadblocks. In total, eleven roadblocks (F1 to F6 and R1 to R5) were evaluated at the HZGJ locus. In FIG. 46A, FIG. 46B, and FIG. 46C, "F" refers to a forward orientation of the dCas9-VP64/sgRNA RNP complex, wherein the forward orientation means the PAM associated with the nucleic acid target binding site of the dCas9-VP64/sgRNA RNP complex faced toward the PAM of the nucleic acid target binding site of the EcoCascade RNP complex; "R" refers to a reverse orientation of the dCas9-VP64/sgRNA RNP complex, wherein the reverse orientation means the PAM associated with the nucleic acid target binding site of the dCas9-VP64/sgRNA RNP complex did not face the PAM of the nucleic acid target binding site of the EcoCascade RNP complex. To the right of the target site indicators (F1 to F6 and R1 to R5), the numbers 1, 2, 3, and 4 correspond to 0, 5, 20, or 50 pmol of dCas9-VP64/sgRNA RNP complex, respectively. The numbers above each heat map (−440 to +100) correspond to bp within the amplicon window, wherein the 0 site was designated 6 bp upstream of the EcoCascade RNP PAM. The grey scale bar to the left of each heat map represents the fraction of mutant classes (0.0-0.5). Deletion start sites appeared to be highly enriched near the dCas9-VP64/sgRNA RNP complex roadblock placement site for roadblocks F4, F5, and F6.

Figure 47A:
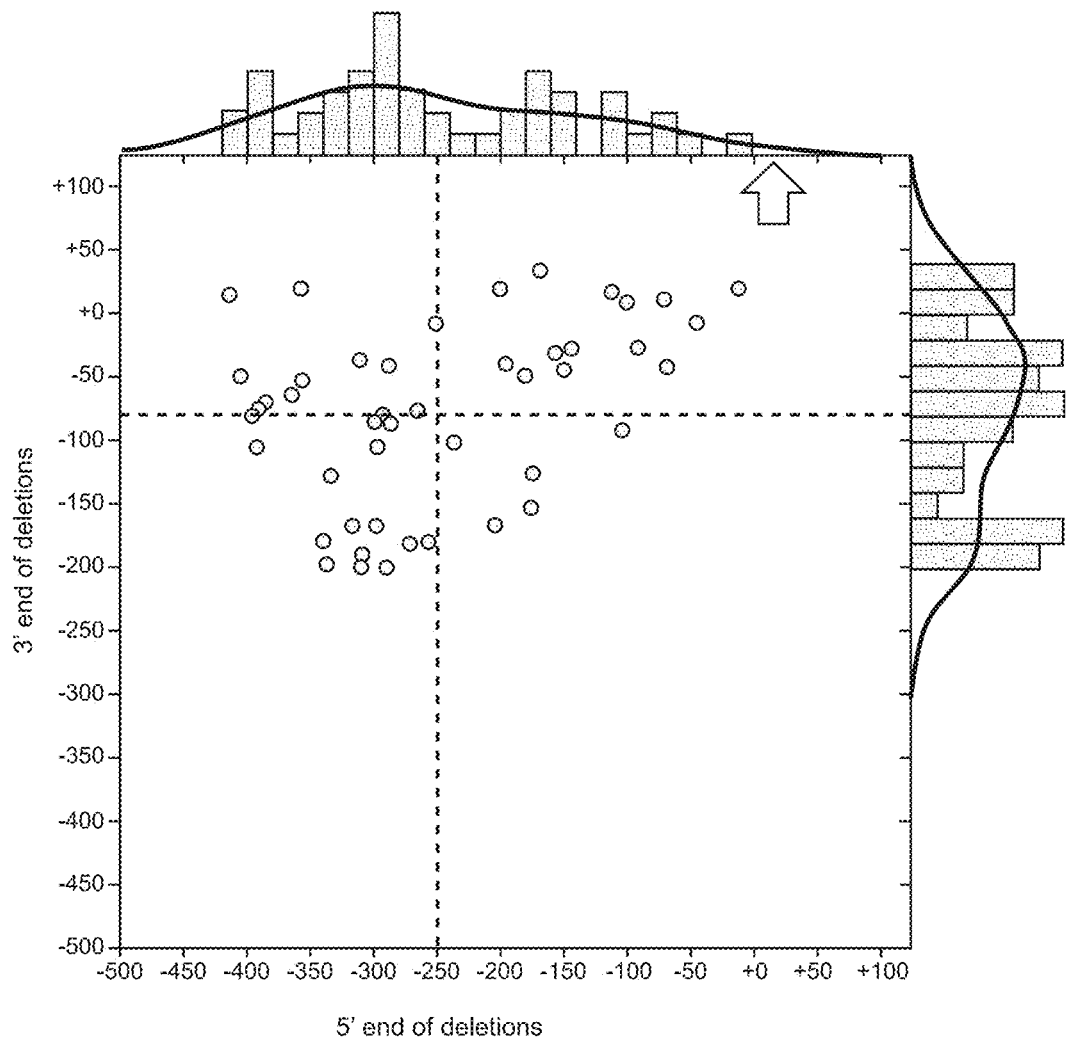
Figure 47B:
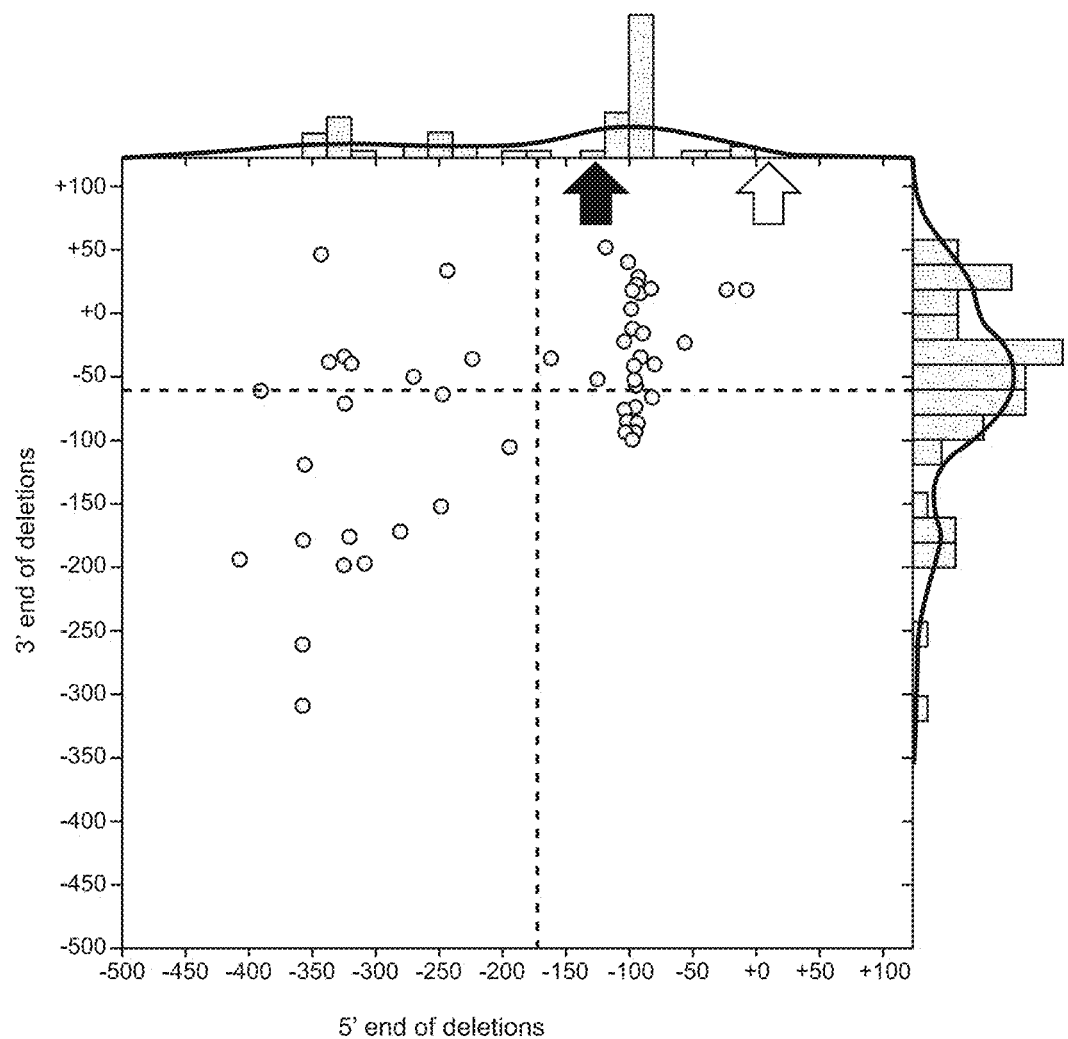

FIG. 47A and FIG. 47B show data for all of the deletions within the amplicon window for samples nucleofected with 3 μg of Cas3-EcoCascade and either 0 pmol (FIG. 47A) or 50 pmol (FIG. 47B) dCas9-VP64/sgRNA RNP complex roadblock. In FIG. 47A and FIG. 47B, the open arrow indicates the relative position of the EcoCas3 protein nick site. In FIG. 47B, the black arrow shows the roadblock placement; i.e., the target binding site for the dCas9-VP64/sgRNA RNP complexes). In FIG. 47A and FIG. 47B, the vertical axis represents the 3' end of the deletion, the units are bp within the amplicon window, and the "0" site was a site designated 6 bp upstream of the EcoCascade RNP PAM; and the horizontal axis represents the 5' end of the deletions, the units are bp within the amplicon window, and the "0" site was designated 6 bp upstream of the EcoCascade RNP PAM. In FIG. 47A and FIG. 47B, the horizontal dashed lines represent the mean location of the 3' end of the deletions, and the vertical dashed lines represent the mean location of the 5' end of the deletions. The bar graph on the top of each of FIGS. 47A and 47B correspond to the distribution of the 5' ends of the deletions, and the curved line represents a kernel density estimation of the 5' ends of the deletions. Similarly, the bar graph to the right of each of FIGS. 47A and 47B correspond to the distribution of the 3' ends of the deletions, and the curved line represents a kernel density estimation of the 3' ends of the deletions. Deletions start sites are highly enriched near the black arrow in FIG. 47B, strongly suggesting that the roadblock prevented Cas3 from deleting gDNA upstream of the roadblock.

The data in this Example support the use of protein roadblocks to control the length of deletions mediated by Cas3 protein associated with Cascade RNP complexes; thus, providing a method to use Cas3 protein associated with Cascade RNP complexes to facilitate formation of deletions having a defined length in the gDNA of cells.

Example 25

Using ATPase Deficient Mutants Linked to Cascade Complexes to Induce Targeted Genomic Deletions Through Paired Nicking This Example illustrates how Cas3 ATPase deficient mutant proteins (mCas3 proteins) can be used to facilitate paired nicking on opposite strands of genomic DNA to induce targeted deletions.

A. Production of mCas3 Protein/EcoCascade and mCas3 Protein-EcoCascade RNP Complex DNA Template Components Minimal CRISPR arrays were made to target two E. coli Cascade (EcoCascade) (SEQ ID NO:1871) RNP complexes to adjacent loci on opposite strands of gDNA in the human genome. An E. coli D452A mCas3 protein (mCas3 [D452A]), an ATPase-deficient variant without helicase activity and therefore only having nicking activity (see, e.g., Mulepati, S., et al., J. Biol. Chem. 288:22184-22192 (2013)), was designed to induce targeted deletions via paired-nicking after EcoCascade RNP complex recruitment. mCas3[D452A] protein was expressed either as a single component separate from EcoCascade (SEQ ID NO:1900) or as a fusion protein linked to the Cas8 protein within the EcoCascade RNP complex (SEQ ID NO:1901) through a 17 amino acid polypeptide linker. When mCas3[D452A] protein was expressed as a single component, the coding sequences were present on an expression vector wherein its expression was under the control of the CMV promoter. Cas3[D452A] protein/EcoCascade refers to mCas3[D452A] protein expressed as a separate component from EcoCascade. mCas3[D452A] protein-Cascade RNP refers to mCas3 [D452A] as a fusion protein linked to the Cas8 protein within the EcoCascade RNP complex. mCas3[D452A] protein-Cascade RNP protein component-encoding genes were cloned into vectors comprising the following: a CMV promoter to enable delivery and expression in mammalian cells, cas genes linked via 2A "ribosome-skipping" sequences, and the ATPase-deficient mutant variant (D452A) of Cas3 attached to Cas8 with a 17-aa linker (SEQ ID NO:1901) to make the mCas3[D452A]-Cas8 fusion protein. When mCas3[D452A] protein was expressed as a fusion protein with Cas8 protein, the fusion protein assembled as part of the EcoCascade RNP complex (mCas3[D452A] protein-EcoCascade RNP complex).

The distances between the two guide target sequences (guide offsets) was between 1 bp and 120 bp. The EcoCascade RNP complexes were oriented such that the PAMs were either facing inward (PAM-in) or outward (PAM-out) relative to the guide RNA target sequence. PAM sequences associated with the nucleic acid target sequences were chosen from the following: AAT, ATA, AAC, AAA, GAG, ATG, AGG, or AAG.

Minimal CRISPR arrays were generated with PCR-based assembly using three oligonucleotides (SEQ ID NO:1513 to SEQ ID NO:1515) and a unique primer encoding a "repeat-spacer-repeat-spacer-repeat" sequence to enable Cascade RNP targeting to adjacent loci. The resulting amplicon will contain an hu6 promoter driving expression of the minimal CRISPR array comprising coding sequences for the guides (see, e.g., Example 20A; FIG. 42A). PCR-assembled minimal CRISPR arrays were purified and concentrated using SPRIselect® (Beckman Coulter, Pasadena, CA) beads essentially according to the manufacturer's instructions.

B. Transfection of Vectors Encoding FokI-Cascade RNP Complex Components

Transfection conditions were performed essentially as described in Example 8B with the following modifications. Prior to nucleofection, 5 μL of solution containing DNA templates was transferred to individual wells of a 96-well plate. For mCas3[D452A] protein/EcoCascade RNP complex expression, wells contained 1.5 μg of plasmid-encoding mCas3[D452A] protein and 1.5 μg of plasmid-encoding EcoCascade, as well as 0.3 μg of linear PCR product encoding the minimal CRISPR array. For mCas3[D452A] protein-EcoCascade RNP complex expression, wells contained 3 μg of plasmid encoding mCas3[D452A]-EcoCascade proteins (including the mCas3[D452A]-Cas8 fusion protein), as well as well as 0.3 μg of linear PCR product encoding the minimal CRISPR array.

C. Deep Sequencing of gDNA from Transfected Cells

Six loci comprising numerous target sites were tested for paired nicking on opposite strands of gDNA (HZGJ locus, 30 target sites; NPHP3-ACAD11 locus, 60 target sites; JAK1 locus 1, 49 target sites; JAK1 locus 2, 33 target sites; NMNAT2 locus, 38 target sites; and ERBB2 locus, 26 target sites). Paired nicking on opposite strands of gDNA was tested for both mCas3[D452A] protein/EcoCascade RNP complexes and mCas3[D452A] protein-EcoCascade RNP complexes comprising guides that directed binding of the Cascade complexes to the target sites.

Deep sequencing was performed essentially as described in Example 8C and analysis as described in Example 8D with the exception that different target specific primers were used corresponding to the targets described above.

Figure 48:
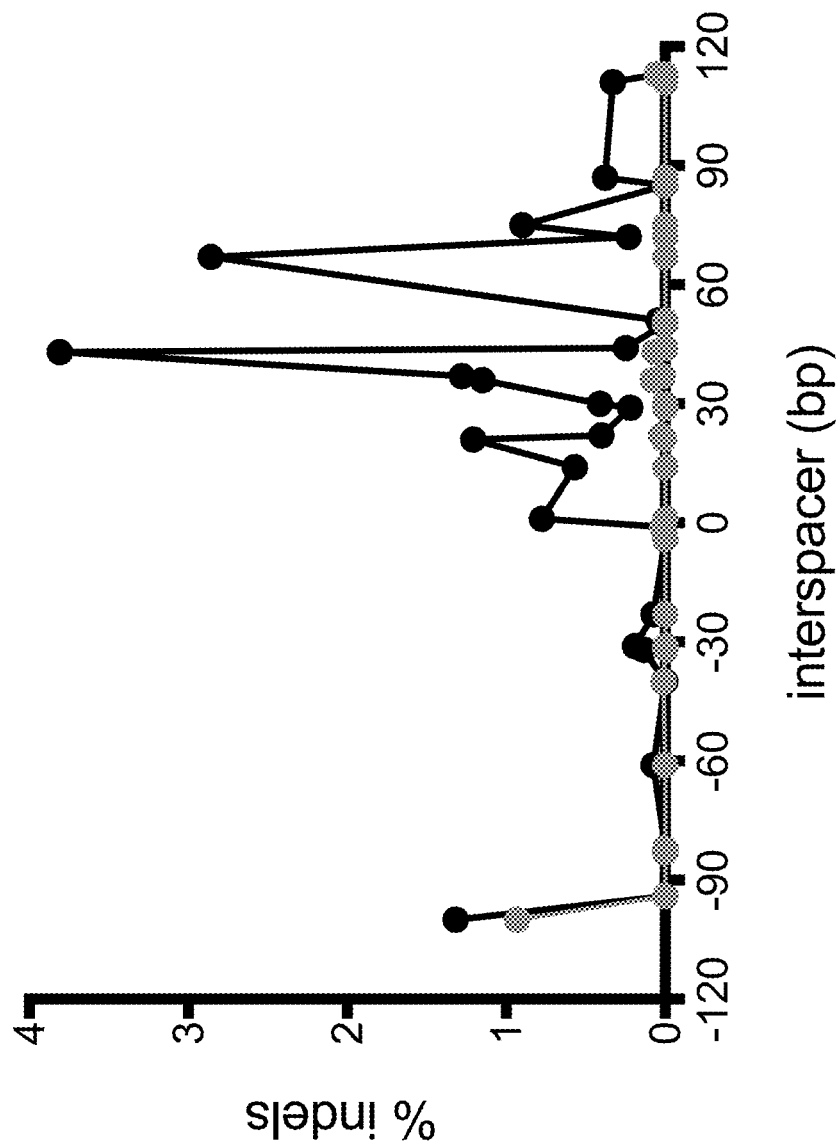
FIG. 48 show exemplary editing data for Cas3[D452A]/-EcoCascade or mCas3[D452A]-EcoCascade.

Table 50 shows exemplary editing data over the 30 HZGJ target sites for mCas3[D452A] protein-EcoCascade RNP complexes targeted to the indicated target sites. FIG. 48 shows exemplary genome editing data at the 30 HZGJ target sites with either mCas3[D452A]/EcoCascade or mCas3 [D452A]-EcoCascade. In FIG. 48, the vertical axis is the % indels and the horizontal axis is the interspacer distance in bp. Here, for each pair of Cascade complexes, one RNP was fixed at particular target site and the second RNP was directed upstream or downstream across a range of distances at different target sites. In FIG. 48, the black circles and black line connecting them correspond to editing with mCas3-EcoCascade, and the grey circles and grey line connecting them correspond to editing with mCas3/EcoCascade. Editing with mCas3/EcoCascade was below the limit of detection for the vast majority of sites, whereas editing with mCas3-EcoCascade ranged from below the limit of detection up to ~4% indels. mCas3-EcoCascade enabled targeted deletions across a range of guide RNA offsets, but was highest with a PAM-out configuration.

TABLE 50

Paired-Nicking Editing Data

|   | A<br>Target ID | B<br>Left Guide Coordinates | C<br>Left Guide PAM Coordinates | D<br>Left Guide PAM Sequence | E<br>Right Guide Coordinates | F<br>Right Guide PAM Coordinates | G<br>Right Guide PAM Sequence | H<br>PAM Orientation | I<br>Guide Offset (bp) | J<br>% Editing |
|---|---|---|---|---|---|---|---|---|---|---|
| 2 | HZGJ_target 1 | chr2: 68157397-68157428 | chr2: 68157429-68157431 | GAG | chr2: 68157436-68157467 | chr2: 68157433-68157435 | AAG | PAM-in | 1 | 0.014 |
| 3 | HZGJ_target 2 | chr2: 68157394-68157425 | chr2: 68157426-68157428 | AAG | chr2: 68157436-68157467 | chr2: 68157433-68157435 | AAG | PAM-in | 4 | 0 |
| 4 | HZGJ_target 3 | chr2: 68157375-68157406 | chr2: 68157407-68157409 | ATA | chr2: 68157436-68157467 | chr2: 68157433-68157435 | AAG | PAM-in | 23 | 0.0747 |
| 5 | HZGJ_target 4 | chr2: 68157367-68157398 | chr2: 6817399-68157401 | AAG | chr2: 68157436-68157467 | chr2: 68157433-68157435 | AAG | PAM-in | 31 | 0.192 |
| 6 | HZGJ_target 5 | chr2: 68157366-68157397 | chr2: 68157398-68157400 | AGG | chr2: 68157436-68157467 | chr2: 68157433-68157435 | AAG | PAM-in | 32 | 0.136 |
| 7 | HZGJ_target 6 | chr2: 68157358-68157389 | chr2: 68157390-68157392 | AAC | chr2: 68157436-68157467 | chr2: 68157433-68157435 | AAG | PAM-in | 40 | 0 |
| 8 | HZGJ_target 7 | chr2: 68157337-68157368 | chr2: 68157369-68157371 | AAG | chr2: 68157436-68157467 | chr2: 68157433-68157435 | AAG | PAM-in | 61 | 0.0752 |
| 9 | HZGJ_target 8 | chr2: 68157316-68157347 | chr2: 68157348-68157350 | AAA | chr2: 68157436-68157467 | chr2: 68157433-68157435 | AAG | PAM-in | 82 | 0 |
| 10 | HZGJ_target 9 | chr2: 68157315-68157346 | chr2: 68157347-68157349 | AAT | chr2: 68157436-68157467 | chr2: 68157433-68157435 | AAG | PAM-in | 83 | 0 |
| 11 | HZGJ_target 10 | chr2: 68157304-68157335 | chr2: 68157336-68157338 | ATG | chr2: 68157436-68157467 | chr2: 68157433-68157435 | AAG | PAM-in | 94 | 0 |
| 12 | HZGJ_target 11 | chr2: 68157298-68157329 | chr2: 68157330-68157332 | AAC | chr2: 68157436-68157467 | chr2: 68157433-68157435 | AAG | PAM-in | 100 | 1.32 |
| 13 | HZGJ_target 12 | chr2: 68157436-68157467 | chr2: 68157433-68157435 | AAG | chr2: 68157469-68157500 | chr2: 68157501-68157503 | AGG | PAM-out | 1 | 0.778 |
| 14 | HZGJ_target 13 | chr2: 68157436-68157467 | chr2: 68157433-68157435 | AAG | chr2: 68157482-68157513 | chr2: 68157514-68157516 | GAG | PAM-out | 14 | 0.57 |
| 15 | HZGJ_target 14 | chr2: 68157436-68157467 | chr2: 68157433-68157435 | AAG | chr2: 68157489-68157520 | chr2: 68157521-68157523 | ATG | PAM-out | 21 | 1.21 |
| 16 | HZGJ_target 15 | chr2: 68157436-68157467 | chr2: 68157433-68157435 | AAG | chr2: 68157490-68157521 | chr2: 68157522-68157524 | AAT | PAM-out | 22 | 0.402 |
| 17 | HZGJ_target 16 | chr2: 68157436-68157467 | chr2: 68157433-68157435 | AAG | chr2: 68157497-68157528 | chr2: 68157529-68157531 | AAT | PAM-out | 29 | 0.222 |
| 18 | HZGJ_target 17 | chr2: 68157436-68157467 | chr2: 68157433-68157435 | AAG | chr2: 68157498-68157529 | chr2: 68157530-68157532 | AAA | PAM-out | 30 | 0.412 |
| 19 | HZGJ_target 18 | chr2: 68157436-68157467 | chr2: 68157433-68157435 | AAG | chr2: 68157504-68157535 | chr2: 68157536-68157538 | AGG | PAM-out | 36 | 1.15 |
| 20 | HZGJ_target 19 | chr2: 68157436-68157467 | chr2: 68157433-68157435 | AAG | chr2: 68157505-68157536 | chr2: 68157537-68157539 | GAG | PAM-out | 37 | 1.28 |
| 21 | HZGJ_target 20 | chr2: 68157436-68157467 | chr2: 68157433-68157435 | AAG | chr2: 68157511-68157542 | chr2: 68157543-68157545 | AAG | PAM-out | 43 | 3.81 |
| 22 | HZGJ_target 21 | chr2: 68157436-68157467 | chr2: 68157433-68157435 | AAG | chr2: 68157512-68157543 | chr2: 68157544-68157546 | AAA | PAM-out | 44 | 0.25 |
| 23 | HZGJ_target 22 | chr2: 68157436-68157467 | chr2: 68157433-68157435 | AAG | chr2: 68157518-68157549 | chr2: 68157550-68157552 | ATA | PAM-out | 50 | 0.011 |
| 24 | HZGJ_target 23 | chr2: 68157436-68157467 | chr2: 68157433-68157435 | AAG | chr2: 68157519-68157550 | chr2: 68157551-68157553 | AAT | PAM-out | 51 | 0.0445 |

TABLE 50-continued

Paired-Nicking Editing Data

| | A Target ID | B Left Guide Coordinates | C Left Guide PAM Coordinates | D Left Guide PAM Sequence | E Right Guide Coordinates | F Right Guide PAM Coordinates | G Right Guide PAM Sequence | H PAM Orientation | I Guide Offset (bp) | J % Editing |
|---|---|---|---|---|---|---|---|---|---|---|
| 25 | HZGJ_target 24 | chr2: 68157436-68157467 | chr2: 68157433-68157435 | AAG | chr2: 68157535-68157566 | chr2: 68157567-68157569 | AGG | PAM-out | 67 | 2.86 |
| 26 | HZGJ_target 25 | chr2: 68157436-68157467 | chr2: 68157433-68157435 | AAG | chr2: 68157540-68157571 | chr2: 68157572-68157574 | ATG | PAM-out | 72 | 0.232 |
| 27 | HZGJ_target 26 | chr2: 68157436-68157467 | chr2: 68157433-68157435 | AAG | chr2: 68157543-68157574 | chr2: 68157575-68157577 | AAC | PAM-out | 75 | 0.901 |
| 28 | HZGJ_target 27 | chr2: 68157436-68157467 | chr2: 68157433-68157435 | AAG | chr2: 68157553-68157584 | chr2: 68157585-68157587 | AAC | PAM-out | 85 | 0 |
| 29 | HZGJ_target 28 | chr2: 68157436-68157467 | chr2: 68157433-68157435 | AAG | chr2: 68157555-68157586 | chr2: 68157587-68157589 | ATA | PAM-out | 87 | 0.38 |
| 30 | HZGJ_target 29 | chr2: 68157436-68157467 | chr2: 68157433-68157435 | AAG | chr2: 68157579-68157610 | chr2: 68157611-68157613 | GAG | PAM-out | 111 | 0.33 |
| 31 | HZGJ_target 30 | chr2: 68157436-68157467 | chr2: 68157433-68157435 | AAG | chr2: 68157581-68157612 | chr2: 68157613-68157615 | AGG | PAM-out | 113 | 0.0549 |

Data from additional loci, following essentially the same protocol as set forth in this Example, showed that the best genomic editing was achieved with the mCas3[D452A]-EcoCascade samples when the Cascade RNP complexes were oriented in a PAM-out configuration. Editing above the limit of detection was seen at 26/238 target sites and editing above 0.1% was seen at 1/238 target sites with mCas3[D452A]/EcoCascade (i.e., below the limit of detection for the majority of sites), whereas editing above the limit of detection with mCas3[D452A]-EcoCascade was seen at 128/242 target sites and editing above 0.1% was seen at 1/238 target sites. mCas3[D452A]-EcoCascade enabled targeted deletions across a range of guide offsets, with the highest being when the Cascade RNP complexes were in a PAM-out configuration.

The data in this Example show that Cascade RNP complexes comprising mCas3 proteins can be used to provide paired nicking on opposite strands of gDNA and thus facilitate targeted deletions in the genomes of host cells (e.g., human cells).

Example 26

Cas3 ATPase Deficient Mutant for Generation of Genomic Deletions

Several methods to limit and/or define the deletion length facilitated by Cascade RNP complexes associated with Cas3 protein are described in the present application. This Example illustrates how a non-paired, ATPase deficient mutant Cas3 protein can be used to generate targeted genomic deletions; thus, providing nicking at a single site using a single Cascade RNP complex.

A. Production of *Pseudomonas* sp. S-6-2 Cas3 Variants and PseCascade RNP Complex Components for Transfection into Target Cells Minimal CRISPR arrays were designed to target *Pseudomonas* sp. S-6-2 Cascade (PseCascade) RNP complexes to eight targets (SEQ ID NO:1902 to SEQ ID NO:1909) in the TRAC locus in the human genome. These sequences are presented in Table 51.

TABLE 51

TRAC Locus Targets

| SEQ ID NO: | Target | Sequence |
|---|---|---|
| 1902 | TRAC 1 spacer | TCTGTCTGCCTATTCACCGATTTTGATTCTCA |
| 1903 | TRAC 2 spacer | TAAGGATTCTGATGTGTATATCACAGACAAAA |
| 1904 | TRAC 3 spacer | GATTCTGATGTGTATATCACAGACAAAACTGT |
| 1905 | TRAC 4 spacer | TCCATAGACCTCATGTCTAGCACAGTTTTGTC |
| 1906 | TRAC 5 spacer | AGCAACAGTGCTGTGGCCTGGAGCAACAAATC |
| 1907 | TRAC 6 spacer | TCAGATTTGTTGCTCCAGGCCACAGCACTGTT |
| 1908 | TRAC 7 spacer | GCGTTTGCACATGCAAAGTCAGATTTGTTGCT |
| 1909 | TRAC 8 spacer | GTGTCTTCTGGAATAATGCTGTTGTTGAAGGC |

Minimal CRISPR arrays were generated with PCR-based assembly using three oligonucleotides (SEQ ID NO:1513 to SEQ ID NO:1515) and a unique primer encoding a "repeat-spacer-repeat-spacer-repeat" sequence to enable PseCascade RNP complex targeting, essentially as described in Example 25A. For this minimal CRISPR array, both spacer sequences were identical. The full set of oligonucleotide sequences to generate the minimal CRISPR arrays are presented in Table 52.

TABLE 52

Oligonucleotides Used to Generate Minimal CRISPR Arrays

| SEQ ID NO: | Target |
|---|---|
| 1910 | TRAC 1 primer |
| 1911 | TRAC 2 primer |
| 1912 | TRAC 3 primer |
| 1913 | TRAC 4 primer |

TABLE 52-continued

Oligonucleotides Used to Generate Minimal CRISPR Arrays

| SEQ ID NO: | Target |
|---|---|
| 1914 | TRAC 5 primer |
| 1915 | TRAC 6 primer |
| 1916 | TRAC 7 primer |
| 1917 | TRAC 8 primer |

PCR-assembled guides were purified and concentrated using SPRIselect® (Beckman Coulter, Pasadena, CA) beads largely according to the manufacturer's instructions.

A D448A ATPase mutant variant of *Pseudomonas* sp. S-6-2 Cas3 (PseCas3; SEQ ID NO:1918) without ATPase/helicase activity and therefore only having nicking activity (termed mPseCas3; SEQ ID NO:1919) was designed to induce targeted deletions. As a point of reference, a D75A nuclease dead variant of PseCas3 (SEQ ID NO:1920) was also generated (termed dPseCas3*), as well as an ATPase nuclease double mutant variant of PseCas3 (SEQ ID NO:1921) (termed dblmPseCas3). The PAM sequences for each target was an AAG.

PseCascade RNP complex protein component-encoding genes as well as mutant PseCas3 genes were cloned into vectors containing CMV promoters to enable delivery and expression in mammalian cells. The PseCascade RNP complex cas genes were linked via 2A "ribosome-skipping" sequences and all genes contained N-terminal NLS sequences to direct the encoded proteins to the nucleus. The sequences are presented in Table 53.

TABLE 53

PseCas3 Cascade Sequences and PseCas3 Mutant Protein Sequences

| SEQ ID NO: | Target |
|---|---|
| 1918 | PseCascade polycistronic plasmid |
| 1919 | D448A Cas3 variant (mCas3) |
| 1920 | D75A Cas3 variant (dCas3) |
| 1921 | D448A D75A Cas3 variant (dblmCas3) |

B. Transfection of Vectors Encoding FokI-Cascade RNP Complex Components

Transfection conditions were performed essentially as described in Example 8B, with the following modifications. Prior to nucleofection, 6 μL of a solution containing the DNA templates was transferred to individual wells of a 96-well plate, wherein the wells contained 3 μg of the plasmid-encoding PseCascade protein components, 0.2 μg of linear PCR product encoding the minimal CRISPR array, and 1 μg of the plasmid-encoding either mPseCas3, dPseCas3*, or dblmCas3.

C. Deep Sequencing of gDNA from Transfected Cells

Deep sequencing was performed essentially as described in Example 8C. However, instead of primers Y and Z from Table 36 of Example 8C, forward and reverse target-specific primers for each of TRAC1 to TRAC8 targets sites were used, as well as a MiSeq reagent kit v3, 600 cycles (Illumina, San Diego, CA).

Figure 49:
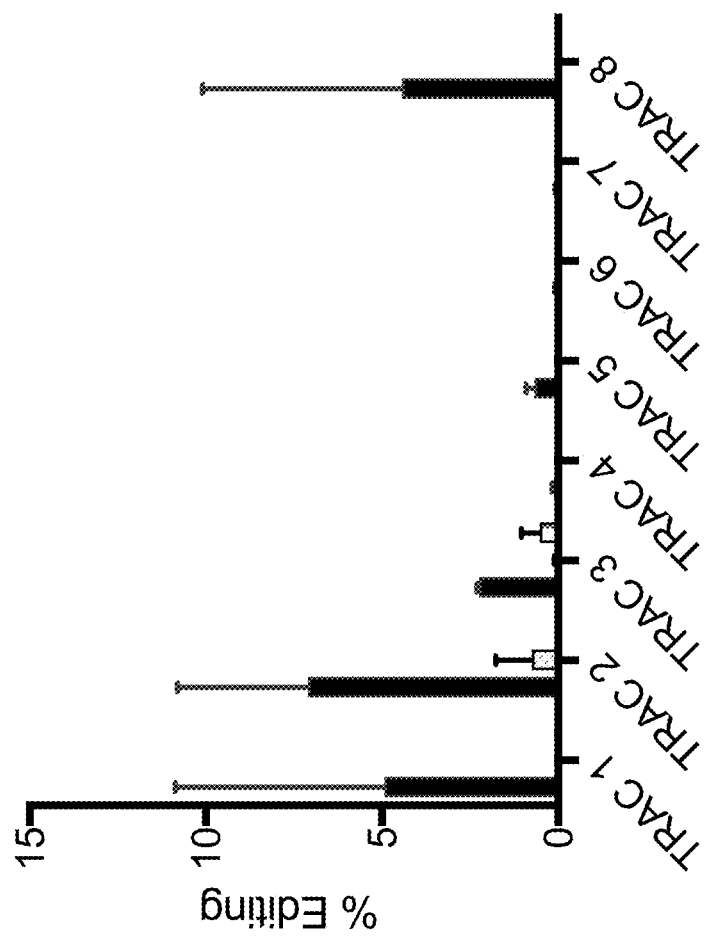
FIG. 49 presents data for genome editing at eight TRAC target sites with PseCascade RNP complexes.

FIG. 49 shows genome editing at the eight TRAC target sites with PseCascade RNP complexes associated with each of mPseCas3, dPseCas3*, or dblmCas3 (n=2). In FIG. 49, the vertical axis is % editing, and the horizontal axis indicates the target sites in the TRAC locus. The order of the bars along the horizontal axis is mPseCas3 (black bars), dPseCas3* (grey bars), and dblmCas3 (striped bars). Editing at the target sites was rarely observed with dPseCas3* or dblmPseCas3 PseCascade RNP complexes, but reached up to ~7% genome editing as detected by deletions at the target site with mPseCas3 PseCascade RNP complexes. These data show that the mPseCas3 protein without ATPase/helicase activity, thus only having nicking activity, can be used with PseCascade RNP complexes at single targets (i.e., not in a paired-nicking configuration) to generate deletions at the expected cleavage site.

As is apparent to one of skill in the art, various modification and variations of the above embodiments can be made without departing from the spirit and scope of this invention. Such modifications and variations are within the scope of this invention.

SEQUENCE LISTING (1927 sequences)

SEQ ID NO: 1 - DNA, 1509 bp, Escherichia coli K-12 MG1655
  misc_feature (1)..(1509): Cas8
atgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctga

SEQ ID NO: 2 - DNA, 483 bp, Escherichia coli K-12 MG1655
  misc_feature (1)..(483): Cse2
atggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaa

SEQ ID NO: 3 - DNA, 1092 bp, Escherichia coli K-12 MG1655
  misc_feature (1)..(1092): Cas7
atgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtga

SEQ ID NO: 4 - DNA, 675 bp, Escherichia coli K-12 MG1655
  misc_feature (1)..(675): Cas5
atgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaa

SEQ ID NO: 5 - DNA, 600 bp, Escherichia coli K-12 MG1655
  misc_feature (1)..(600): Cas6
atgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtga

SEQ ID NO: 6 - DNA, 1509 bp, Escherichia coli K-12 MG1655
  misc_feature (1)..(1509): Cas8
atgaatctgctgattgataattggattccggttcgtccgcgtaatggtggtaaagttcagattattaatctgcagagcctgtattgtagccgtgatcagtggcgtctgagcctgccgcgtgatgatatggaactggcagcactggcactgctggtttgtattggtcagattattgcaccggcaaaagatgatgttgaatttcgccatcgtattatgaatccgctgaccgaagatgaatttcagcagctgattgccccgtggattgatatgttttatctgaatcatgcagaacatccgtttatgcagaccaaaggtgttaaagcaaatgatgttaccccgatggaaaaactgctggccggtgttagcggtgcaaccaattgtgcatttgttaatcagccgggtcagggtgaagcactgtgtggtggttgtaccgcaattgcactgtttaatcaggcgaatcaggccccgggttttggtggtggttttaaaagcggtctgcgtggtggtacaccggttaccacctttgttcgtggtattgatctgcgtagcaccgttctgctgaatgttctgaccctgccgcgtctgcagaaacagtttccgaatgaaagccataccgaaaatcagccgacctggattaaaccgattaaaagcaatgaaagcattccggcaagcagcattggttttgtgcgtggtctgttttggcagccggcacatattgaactgtgtgatccgattggtattggtaaatgtagctgttgtggtcaggaaagcaatctgcgttataccggctttctgaaagagaaatttacctttaccgttaatggtctgtggccgcatccgcatagcccgtgtctggttaccgtgaaaaaaggtgaagttgaagaaaaatttctggcatttaccaccagcgcaccgagctggacccagattagccgtgttgttgttgataaaattattcagaatgaaaatggcaatcgtgttgcagcagttgtgaatcagtttcgtaatattgcgccgcagagcccgctggaactaattatgggtggttatcgtaataatcaggcaagcattctggaacgccgtcatgatgttctgatgtttaatcagggttggcagcagtatggtaatgtgattaatgaaattgtgaccgttggtctgggctataaaaccgcactgcgtaaagcgctgtatacctttgccgaaggctttaaaaacaaagattttaaaggtgcaggcgttagcgttcatgaaaccgccgaacgtcatttttatcgtcagagcgaactgctgattccggatgtgctggcaaatgttaattttagccaggcagatgaagttattgcagatctgcgcgataaactgcatcagctgtgtgaaatgctgtttaatcagagcgttgcaccgtatgcacatcatccgaaactgattagcaccctggccctggcacgtgcaaccctgtataaacatctgcgtgaactgaaaccgcagggtggtccgagcaatggttaa

SEQ ID NO: 7 - DNA, 483 bp, Escherichia coli K-12 MG1655
  misc_feature (1)..(483): Cse2
atggcagatgaaattgatgcaatggcactgtatcgtgcatggcagcagctggataatggtagctgtgcacagattcgtcgtgttagcgaaccggatgaactgcgtgatattccggcattttatcgtctggttcagccgtttggttgggaaaatccgcgtcatcagcaggcactgctgcgtatggttttttgtctgagcgcaggtaaaaatgttattcgtcatcaggataaaaaaagcgaacagaccaccggtattagcctgggtcgtgcactggcaaatagcggtcgtattaatgaacgtcgtatttttcagctgattcgtgcagatcgtaccgcagatatggttcagctgcgtcgtctgctgacccatgcagaaccggttctggattggccgctgatggcacgtatgctgacctggtggggtaaacgtgaacgtcagcagctgctggaagattttgttctgaccaccaataaaaatgcctaa

SEQ ID NO: 8 - DNA, 1092 bp, Escherichia coli K-12 MG1655
  misc_feature (1)..(1092): Cas7
atgagcaactttattaatattcatgtgctgattagccatagcccgagctgcctgaatcgtgatgatatgaatatgcagaaagatgccatttttggcggtaaacgtcgtgttcgtattagcagccagagcctgaaacgtgcaatgcgtaaaagcggttattatgcacagaatattggtgaaagcagcctgcgtaccattcatctggcacagctgcgtgatgttctgcgtcagaaactgggtgaacgttttgatcagaaaattattgataaaaccctggcactgctgagtggcaaaagcgttgatgaagcagaaaaaattagcgcagatgcagttaccccgtgggttgttggtgaaattgcctggttttgcgaacaggttgccaaagccgaagcagataatctggatgataaaaaactgctgaaagttctgaaagaagatattgccgccattcgtgttaatctgcagcagggtgttgatattgcactgagcggtcgtatggcaaccagcggtatgatgaccgaactgggtaaagttgatggtgcaatgagcattgcacatgcaattaccacccatcaggttgatagcgatattgattggtttaccgcagttgatgatctgcaggaacagggtagcgcacatctgggtacacaggaatttagcagcggtgtgttttatcgttatgcaaatattaatctggcccagctgcaggaaaatctgggtggtgcaagccgtgaacaggcactggaaattgcaacccatgttgttcatatgctggcaaccgaagttccgggtgcaaaacagcgtacctatgcagcctttaatccggcagatatggttatggttaattttagcgatatgccgctgtcaatggcaaatgcctttgaaaaagcagtgaaagccaaagatggttttctgcagccgagcattcaggcatttaatcagtattgggatcgtgttgcaaatggctatggtctgaatggtgcagcagcacagtttagcctgagcgatgttgatccgattaccgcacaggttaaacagatgccgaccctggaacagctgaaaagctgggttcgtaataatggtgaagcataa

SEQ ID NO: 9 - DNA, 675 bp, Escherichia coli K-12 MG1655
  misc_feature (1)..(675): Cas5
atgcgtagctatctgattctgcgtctggcaggtccgatgcaggcatggggtcagccgacatttgaaggtacacgtccgacaggtcgttttccgacacgtagtggtctgctgggtctgctgggtgcatgtctgggtattcagcgtgatgataccagcagtctgcaggcactgagcgaaagcgtgcagtttgcagttcgttgtgatgaactgattctggatgatcgtcgtgttagcgtgaccggtctgcgtgattatcataccgttctgggtgcacgtgaagattatcgtggtctgaaaagccatgaaaccattcagacctggcgtgaatatctgtgtgatgcaagttttaccgttgcactgtggctgaccccgcatgcaacaatggttattagcgaactggaaaaagcagttctgaaaccgcgttataccccgtatctgggtcgtcgtagctgtccgctgacccatccgctgtttctgggtacatgtcaggcaagcgatccgcagaaagcactgctgaattatgaaccggttggtggtgatatttatagcgaagaaagcgttaccggtcatcatctgaaatttaccgcacgtgatgaaccgatgattaccctgccgcgtcagtttgcaagccgtgaatggtatgttattaaaggtggtatggatgttagccagtaa

SEQ ID NO: 10 - DNA, 600 bp, Escherichia coli K-12 MG1655
  misc_feature (1)..(600): Cas6
atgtatctgagcaaagttattattgcacgtgcatggagccgtgatctgtatcagctgcatcagggtctgtggcatctgtttccgaatcgtccggatgcagcccgtgattttctgtttcatgttgaaaaacgtaataccccggaaggttgtcatgttctgctgcagagcgcacagatgccggttagcaccgcagttgcaaccgttattaaaaccaaacaggtggaatttcagctgcaggttggtgttccgctgtattttcgtctgcgtgccaatccgattaaaaccattctggataatcagaaacgtctggatagcaaaggtaatattaaacgttgccgcgtgccgctgattaaagaagccgaacagattgcatggctgcagcgtaaactgggtaatgcagcacgtgttgaagatgttcatccgattagcgaacgtccgcagtattttagcggtgatggtaaaagcggtaaaattcagaccgtttgttttgaaggtgttctgaccattaatgatgcaccggcactgattgatctggttcagcagggtattggtccggcaaaaagcatgggttgtggtctgctgagtctggccccgctgtaa

SEQ ID NO: 11 - DNA, 1509 bp, Escherichia coli K-12 MG1655
  misc_feature (1)..(1509): Cas8
atgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaa

SEQ ID NO: 12 - DNA, 483 bp, Escherichia coli K-12 MG1655
  misc_feature (1)..(483): Cse2
atggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgcctaa

SEQ ID NO: 13 - DNA, 1092 bp, Escherichia coli K-12 MG1655
  misc_feature (1)..(1092): Cas7
atgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaa

SEQ ID NO: 14 - DNA, 675 bp, Escherichia coli K-12 MG1655
  misc_feature (1)..(675): Cas5
atgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagtaa

SEQ ID NO: 15 - DNA, 600 bp, Escherichia coli K-12 MG1655
  misc_feature (1)..(600): Cas6
atgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaa

SEQ ID NO: 16 - protein, 502 aa, Escherichia coli K-12 MG1655
  misc_feature (1)..(502): Cas8
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 17 - protein, 160 aa, Escherichia coli K-12 MG1655
  misc_feature (1)..(160): Cse2
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 18 - protein, 363 aa, Escherichia coli K-12 MG1655
  misc_feature (1)..(363): Cas7
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 19 - protein, 224 aa, Escherichia coli K-12 MG1655
  misc_feature (1)..(224): Cas5
MRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQ

SEQ ID NO: 20 - protein, 199 aa, Escherichia coli K-12 MG1655
  misc_feature (1)..(199): Cas6
MYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 21 - protein, 888 aa, Escherichia coli K-12 MG1655
  misc_feature (1)..(888): Cas3
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 22 - DNA, 1455 bp, Oceanicola sp. HL-35
  misc_feature (1)..(1455): Cas8
atgacggtttcgttgaatctgatcactgaccgctggatccccgtcctagacaccacaggcacccgccatacgattgcaccctgggagatggccgattcctcgttcgtcgccccggactggccgcgccccgatctgaacacggcctgcctggagctgctgatcggcctcgtccgtctggccgatccgcctgcccatcccgacgattgggaggataggcaagctccggatgctgatcgcttgcgcgaccgccttgctcctttcgccccagccttcaaccttctgggtgatgggccgcggttcatgcaggaaatgggggggctggttggcgatgtccgagccactgacgtgcttttcattgattccggtggtgatggcggtgcgctgacagtgcgtgaaggacgataccccaacctggacctgcccacggcggcaatggcgctttatgccatgcagacgcaggccccatcgggtggacggggtaatctgacatcgctgcgcggcggcggcccgatgacggtgctggtcgatccaggtggcgggatgtggcctctcatttgggccaacgtgccagacggcaaacctgtcgtgccaaatgttctgccatggatgaggcgcacggtgacttcagaaactggagtgcggttcttcccacatcaaggagatgcagccgaggtgttcttcggtatgccgcgtcggttgtggctagaggctcggaacgacagtgtcactggggtgatccagcgaccctccggcacgaaatacgtgggctggcgtcatcccctgacgccctactatcgccagaaggcgggtgacacgccgctacctgtgcggccgcgcgccggggtgtttggttatcgccactggctaggtattgctgccgaacagggcagtgatctgcgcgagcgccctgcgacggtagaggcgtgggaaagtcgcggtcttggccgccgagctgacatcattgtggccggctgggcaatggagaacatgaaggctcgcgattacatatggtcgcgggcgccgctggtgaccctgcccgaagagcgagcggcctttctccgcgatatgatcgaagcggccgatttactttcggcagccctgcgtggtgccctagccacgcttctgggcgagggagaggggcgtgaggcggcgcgggaagcgttctatgtccgcacgcaggccgccttcgaggggtgggtttcttgtctggataccattgctctggacgccgctgcgcgtggctggctggccgacatgcgcaaggtggcgctggagattttcgaggtgctggcgctgcccggtttggcggatcgcactatcctcgttcaacaggaaatcgtcgccgcgcatcgcgggctgaccggcagcttctcgggctatggaaagcttgggaccaaggcgtttggcgttctgaacctacctgtgccgacacgcaagaaggaggcggcgacatga

SEQ ID NO: 23 - DNA, 525 bp, Oceanicola sp. HL-35
  misc_feature (1)..(525): Cse2
atgagcgatcgcaagcaggtcatcggcacatggtggcggaccaggattggtgcccgcaactccaccgcggcgcgtgcgctggcggccaggctgaaccggggcgagggggtggacgtgctcgcggagcgggcagtcttcgagcttggccgggacttgggcttcctgaagcaacccaaacgtctggtgctgcttgtgcgggtgctggcggcggtgcgtgaggatcgggggggagcgttgccactaagactggggcagggggatcctccacccctatcgccgttgcgttttcagcgtcttttgcgcgccgaaggcgaggagttgaccacgcttctgcgccgcgccctccctatggtcacacggacctgcgacgtgggcgcgcttggcgccgatctgcttgactggtctgactccacccgcgcccgctgggccttcgcctatttcggcgcgaccccgcccgccagaatcaacaactccagaccaacccctgaaacgcccgccctatccgatcaggagaccgaggaatga

SEQ ID NO: 24 - DNA, 1083 bp, Oceanicola sp. HL-35
  misc_feature (1)..(1083): Cas7
atgacgacctttttgcaatttcatgtgctgacgacctatcccccgtcgaaccctaaccgcgacgatcagggccgtccgaagcaggccaatctcggcggcgctccccggctacggctatcgtcgcaatcgatcaagcgggcaatgcgtgagagcccggcatttcagcagggtcttgatggccatatcggcacgcgaacgaagcgactgggcgaagaaatccgcgaagagttggccaagcgagagggcgtgtcgaccgatcaggcgctcgatgtggcttcaaaggtcgccgcgatcttctctaagctggaggcgccgggcaaggataaggtgcaaaaaccacttaccaccactctggccttcgtgtcgcccgacgaatgggcattggcccgcgatctggcgagccggatgttggcgggcgaggagatgccgaaggacaaggaactgaagcgtctggttctccgccgtgccgacggggcagtggatatcgccatgttcggccggatgctggcggatgaaccgggctacaaccgcgaggccgccgtgcaggtgagccacgccatcaccacccatcgcgccattgccgaggacgattggtattccgccgtcgacgatcttaacaagcgcgaggattcaggtgccggacacttgggcgagcatggtttcggttcgggcgtctattacctctatgcctgcgtcaacgtcgatcttctggtagagaacctcgcgggcgatcgggcactcgccgcccgtggtctcgaagcgttggcaaaggcgctcgctaccgcaacaccacgcgggaagcagaacagccatgcccaccacccccgcgcgatctatgtccgcgccgaacgcgggccgcaacagccgcgcgacctgaccggggccttcttttctgctgtggacctgaagtcgaatgacatcgagcggacatcaatcatcgcactggagagaaccgccgaacagattgatcgcgcctacggtgccgcttgtgacgataccgcggtaatggacgtgaaggaggggaatggcactctggccgagatcgctgccttttctggcgcgtcggtatctgccaatgcgtga

SEQ ID NO: 25 - DNA, 765 bp, Oceanicola sp. HL-35
  misc_feature (1)..(765): Cas5
atggcactctggccgagatcgctgccttttctggcgcgtcggtatctgccaatgcgtgagcatttggtctttaccttggccgcggctgtcgcctcgatgggcgaactggcagggcacgagcggcgtggcacctggtcttggccgggacggtcgtcagttctgggcttgtgcgcagcagcccttggtatccggcgtgatggcgatttcagtgcgcttgacggactcgggctggcagtggctgtgttcgatacaggcgaaccgctgcgggattttcacacagccgtcagtatcccgtcgtcagtagcaaagagaccgcagtcgcgtgcagatgcgttgcggatcgacgctggacgcagcaattccacgatcacattgcgcgattaccgggtcggagtgctttatggtgtcgcgttgtggggcgacggcctcccgactgttgcagagaatctggtcgaggctctgcaacggccgaccttcacgctctacttggggcgtaagtcctgccccttggcggccccgcttgcgccacgtgtcctgacggcacccgacgctgcggcggcgctgacagacggaatgacgctaccaccgtggcgtgctggtgcccgtgcaggccagatcgctaccgaagaggaattgcccgcacctcgcacggaaacccgccacgaccggcccactgatcgcaccgcatggcatttcgccccgcgcgcggtgcgtctcgttccctgtgatatcgcacctcgcactgctggacaggtggctgcatga

SEQ ID NO: 26 - DNA, 708 bp, Oceanicola sp. HL-35
  misc_feature (1)..(708): Cas6
atgaccctctggctatcccgagtccgcatcgctcgtggtgctgatcttgatacgctgcggccgctcttggacccaagtgcgctgcatccggcggcgatggacccaaagatgttgggctctcaaacagacgcgcatcaccgcctgatctggacgctgtttgccgatagtcgtgaccggcgccgcgatttcctgtggcgagccgagggtgcagggaagttcactttgctgtcgctgcgtccacctacggcgtcacgagtgtttgaggcacccgaggtgaaggctttctctcctgatcttttgcccggtgaccggctggccttcgctttgcgcgccaacgcaacccgagaccgggccgggtcagccaagggacggcgagtcgatgtggtgatgcacgccttgcataacgtgccgcccgaggaccgcgctgcggcccggatgactctggctcaggacgccgcctcggattggttgacggggcagggcgcgcgcgcgggcttcgtgccggaagaggtgacagcaggtgattattccgtggccgcacttccaagccacactggtaggcgaaaggggcagccgcagtatggtatcctcgatctgaccggcgtgctgcgcgtgaccgatccggcggctttccttgcacggctgggccagggctttggtagggcacgtggttttggttgcgggcttatgctgatccggcgggcctga

SEQ ID NO: 27 - DNA, 1455 bp, Oceanicola sp. HL-35
  misc_feature (1)..(1455): Cas8
atgacagtgagcctgaatctgatcaccgatcgctggattcccgtgctggacacaaccggaacacggcacaccatcgcaccttgggagatggccgacagctcctttgtggccccagattggcccagacctgacctgaacaccgcctgtctggagctgctgatcggactggtgcgcctggccgatccccctgcacaccccgacgattgggaggacaggcaggcccctgacgcagataggctgagggatagactggcaccttttgccccagccttcaatctgctgggcgacggcccacgcttcatgcaggagatgggaggactggtgggcgatgtgcgggcaacagacgtgctgtttatcgattccggcggcgacggaggcgccctgaccgtgagagagggcaggtacccaaacctggacctgccaacagcagcaatggcactgtatgcaatgcagacccaggcacctagcggcggaagaggaaatctgacatccctgaggggaggaggaccaatgaccgtgctggtggaccccggaggaggaatgtggcctctgatctgggcaaacgtgcccgacggcaagccagtggtgcctaatgtgctgccttggatgagaaggacagtgaccagcgagaccggcgtgaggttctttccacaccagggcgatgccgccgaggtgttctttggaatgccacgccggctgtggctggaggcacgcaacgactccgtgacaggcgtgatccagcggccctctggcaccaagtatgtgggctggcgccacccactgacaccctactataggcagaaggcaggcgataccccactgcccgtgaggcctagggcaggcgtgttcggatacaggcactggctgggaatcgcagcagagcagggctctgacctgagggagagaccagcaaccgtggaggcctgggagagccgcggactgggcagaagggccgatatcatcgtggccggctgggccatggagaatatgaaggcaagggactatatctggtcccgggcacctctggtgacactgccagaggagagagccgcctttctgagggatatgatcgaggccgccgacctgctgtctgccgccctgaggggcgccctggccaccctgctgggcgagggcgagggcagagaggccgccagggaggccttttacgtgagaacacaggccgccttcgagggctgggtgagctgtctggataccatcgccctggacgcagcagcaaggggatggctggccgatatgcggaaggtggccctggagatcttcgaggtgctggccctgccaggactggcagacagaaccatcctggtgcagcaggagatcgtggcagcacacaggggactgacaggcagcttctccggctacggcaagctgggcaccaaggcctttggcgtgctgaacctgcctgtgccaacacggaagaaggaggccgccacctaa

SEQ ID NO: 28 - DNA, 525 bp, Oceanicola sp. HL-35
  misc_feature (1)..(525): Cse2
atgagcgacaggaagcaggtcatcggcacatggtggagaaccaggatcggcgccagaaactccaccgcagcaagggccctggcagcacggctgaatagaggagagggagtggatgtgctggcagagagggccgtgtttgagctgggaagggacctgggcttcctgaagcagccaaagcgcctggtgctgctggtgcgggtgctggcagccgtgagggaggataggggaggcgccctgcctctgaggctgggccagggcgaccctccacccctgagcccactgcggtttcagagactgctgagggcagaaggagaggagctgacaaccctgctgaggcgcgccctgccaatggtgacacgcacctgcgacgtgggcgccctgggagcagacctgctggattggtccgactctacacgcgcaagatgggcctttgcctatttcggcgccacccctccagccagaatcaacaatagcaggccaacacccgagacccccgccctgtccgatcaggagacagaggagtaa

SEQ ID NO: 29 - DNA, 1083 bp, Oceanicola sp. HL-35
  misc_feature (1)..(1083): Cas7
atgaccacatttctgcagttccacgtgctgaccacatatcccccttctaaccctaatagggacgatcagggccggccaaagcaggcaaacctgggaggagcaccaaggctgcggctgagctcccagtctatcaagagggcaatgagggagagccctgcattccagcagggcctggatggacacatcggcacacggaccaagagactgggcgaggagatcagggaggagctggcaaagagggagggcgtgagcaccgatcaggccctggacgtggcatctaaggtggcagccatcttcagcaagctggaggcccccggcaaggacaaggtgcagaagcctctgaccacaaccctggcctttgtgagcccagatgagtgggcactggcaagagacctggcatccaggatgctggcaggagaggagatgcccaaggataaggagctgaagcgcctggtgctgcggagagcagatggagcagtggacatcgcaatgttcggaaggatgctggcagacgagccaggatataacagggaggcagcagtgcaggtgagccacgcaatcacaacccacagagccatcgccgaggacgattggtactctgccgtggacgatctgaataagagggaggatagcggcgcaggacacctgggagagcacggatttggctccggcgtgtactatctgtacgcctgcgtgaacgtggatctgctggtggagaatctggcaggcgaccgcgccctggcagcaaggggcctggaggccctggcaaaggccctggcaacagcaaccccaagaggcaagcagaactctcacgcccaccaccccagggcaatctatgtgagggcagagaggggaccacagcagcctagggacctgaccggcgccttcttttctgccgtggatctgaagagcaatgacatcgagcggacatccatcatcgccctggagagaaccgccgagcagatcgatagggcatacggagcagcatgcgacgatacagccgtgatggacgtgaaggagggaaacggcaccctggcagagatcgcagccttcagcggcgcatctgtgagcgccaatgcataa

SEQ ID NO: 30 - DNA, 765 bp, Oceanicola sp. HL-35
  misc_feature (1)..(765): Cas5
atggcactgtggcctcggtctctgccattcctggcccggagatacctgccaatgcgggagcacctggtgtttacactggccgccgccgtggcctccatgggagagctggcaggacacgagaggaggggcacctggtcttggcccggcagatctagcgtgctgggcctgtgcgcagccgccctgggcatccggcgggacggcgatttctccgccctggacggactgggactggcagtggccgtgtttgatacaggagagccactgagggacttccacaccgccgtgtccatcccatcctctgtggccaagaggccacagtctcgggcagatgccctgcgcatcgacgcaggccggagcaactccacaatcaccctgcgcgattacagggtgggcgtgctgtatggagtggccctgtggggcgacggactgcctaccgtggccgagaatctggtggaggccctgcagcgcccaacattcaccctgtacctgggccggaagagctgtccactggcagcaccactggcaccccgcgtgctgacagccccagatgcagcagccgccctgacagacggaatgaccctgccaccatggagagcaggagcaagggcaggccagatcgcaaccgaggaggagctgcctgcaccaagaacagagaccagacacgataggccaacagacaggaccgcctggcactttgcaccaagggccgtgcggctggtgccttgcgatatcgccccaagaacagcaggacaggtggcagcataa

SEQ ID NO: 31 - DNA, 708 bp, Oceanicola sp. HL-35
  misc_feature (1)..(708): Cas6
atgacactgtggctgagccgggtgcggatcgcaagaggagcagacctggataccctgaggccactgctggaccccagcgccctgcacccagcagcaatggaccccaagatgctgggctcccagacagacgcccaccacagactgatctggaccctgtttgccgattccagagacaggcgccgggacttcctgtggagggcagagggcgccggcaagtttacactgctgagcctgagaccccctaccgcctccagggtgtttgaggcccctgaggtgaaggccttcagcccagatctgctgccaggcgacaggctggccttcgccctgcgggccaacgccacccgcgatcgggccggctccgccaagggcagaagggtggacgtggtcatgcacgccctgcacaatgtgccacccgaggatagggcagcagcaaggatgacactggcacaggatgcagcaagcgactggctgaccggacagggagccagagcaggattcgtgcccgaggaggtgacagcaggcgactactccgtggccgccctgccttctcacaccggccggagaaagggccagccacagtatggcatcctggatctgacaggcgtgctgagagtgaccgaccctgcagcctttctggcaaggctgggacagggatttggaagagcaaggggattcggatgcggactgatgctgatcagaagggcataa

SEQ ID NO: 32 - protein, 484 aa, Oceanicola sp. HL-35
  misc_feature (1)..(484): Cas8
MTVSLNLITDRWIPVLDTTGTRHTIAPWEMADSSFVAPDWPRPDLNTACLELLIGLVRLADPPAHPDDWEDRQAPDADRLRDRLAPFAPAFNLLGDGPRFMQEMGGLVGDVRATDVLFIDSGGDGGALTVREGRYPNLDLPTAAMALYAMQTQAPSGGRGNLTSLRGGGPMTVLVDPGGGMWPLIWANVPDGKPVVPNVLPWMRRTVTSETGVRFFPHQGDAAEVFFGMPRRLWLEARNDSVTGVIQRPSGTKYVGWRHPLTPYYRQKAGDTPLPVRPRAGVFGYRHWLGIAAEQGSDLRERPATVEAWESRGLGRRADIIVAGWAMENMKARDYIWSRAPLVTLPEERAAFLRDMIEAADLLSAALRGALATLLGEGEGREAAREAFYVRTQAAFEGWVSCLDTIALDAAARGWLADMRKVALEIFEVLALPGLADRTILVQQEIVAAHRGLTGSFSGYGKLGTKAFGVLNLPVPTRKKEAAT

SEQ ID NO: 33 - protein, 174 aa, Oceanicola sp. HL-35
  misc_feature (1)..(174): Cse2
MSDRKQVIGTWWRTRIGARNSTAARALAARLNRGEGVDVLAERAVFELGRDLGFLKQPKRLVLLVRVLAAVREDRGGALPLRLGQGDPPPLSPLRFQRLLRAEGEELTTLLRRALPMVTRTCDVGALGADLLDWSDSTRARWAFAYFGATPPARINNSRPTPETPALSDQETEE

SEQ ID NO: 34 - protein, 360 aa, Oceanicola sp. HL-35
  misc_feature (1)..(360): Cas7
MTTFLQFHVLTTYPPSNPNRDDQGRPKQANLGGAPRLRLSSQSIKRAMRESPAFQQGLDGHIGTRTKRLGEEIREELAKREGVSTDQALDVASKVAAIFSKLEAPGKDKVQKPLTTTLAFVSPDEWALARDLASRMLAGEEMPKDKELKRLVLRRADGAVDIAMFGRMLADEPGYNREAAVQVSHAITTHRAIAEDDWYSAVDDLNKREDSGAGHLGEHGFGSGVYYLYACVNVDLLVENLAGDRALAARGLEALAKALATATPRGKQNSHAHHPRAIYVRAERGPQQPRDLTGAFFSAVDLKSNDIERTSIIALERTAEQIDRAYGAACDDTAVMDVKEGNGTLAEIAAFSGASVSANA

SEQ ID NO: 35 - protein, 254 aa, Oceanicola sp. HL-35
  misc_feature (1)..(254): Cas5
MALWPRSLPFLARRYLPMREHLVFTLAAAVASMGELAGHERRGTWSWPGRSSVLGLCAAALGIRRDGDFSALDGLGLAVAVFDTGEPLRDFHTAVSIPSSVAKRPQSRADALRIDAGRSNSTITLRDYRVGVLYGVALWGDGLPTVAENLVEALQRPTFTLYLGRKSCPLAAPLAPRVLTAPDAAAALTDGMTLPPWRAGARAGQIATEEELPAPRTETRHDRPTDRTAWHFAPRAVRLVPCDIAPRTAGQVAA

SEQ ID NO: 36 - protein, 235 aa, Oceanicola sp. HL-35
  misc_feature (1)..(235): Cas6
MTLWLSRVRIARGADLDTLRPLLDPSALHPAAMDPKMLGSQTDAHHRLIWTLFADSRDRRRDFLWRAEGAGKFTLLSLRPPTASRVFEAPEVKAFSPDLLPGDRLAFALRANATRDRAGSAKGRRVDVVMHALHNVPPEDRAAARMTLAQDAASDWLTGQGARAGFVPEEVTAGDYSVAALPSHTGRRKGQPQYGILDLTGVLRVTDPAAFLARLGQGFGRARGFGCGLMLIRRA

SEQ ID NO: 37 - DNA, 90 bp, Oceanicola sp. HL-35
  misc_feature (1)..(90): CRISPR
ctgttccccgcacacgcggggatgaaccgggttcttcgatctgcgcatccatgatgccgccctgttccccgcacacgcggggatgaaccg

SEQ ID NO: 38 - DNA, 1554 bp, Pseudomonas sp. S-6-2
  misc_feature (1)..(1554): Cas8
atggatttgttaagtgatacctggctgcagtgccgccatcgtgatggcacgctgaagccgatagctattgggcagatagggctagaagactgtttagagctggttgcgccacgccccgacttccgtggtgcgctctatcagtttctgatcgggttgctgcaaaccgcctacgcgccagaggatcttcaggagtggcgtgatcgctatgccaacccacctaccgctgatgacctggcagaggttttcgctccttaccgcgacgccttccagctggaaaactcagggcctacctttatgcaggacctgaccttgcccgatgacgtcaatcagctgccggtgctggagctgttgattgatgccggctcatcgagcaatcagtatttcaacaagccggcggttgagcacggcatgtgcgagggctgctttacccaggcgttgctcaccatgcagttgaacgcgccctctggcggacgaggcattcggacctcgctgcgtggtggcggtccgttgacgaccttgctggtgccagccgaacagaacgcgacgctttggcaaaagctctggctcaacgtcttgcctcttgatgcactcgatcacccgccgatcaagatgctcagtgacgtattgccctggctggcaccaacccgcaccagcgatgacaaacagggccaggatacaccgccggagtcggtgcaccccttgcaggcgtactggagcatgccgcggcgcattcgcctggatgcagccaccttggatcagggggattgcgcggtatgcggtgcccagaatgtaaagcgtatccgtcattaccgtacccgccatggcggcaccaactacaccgggacatggactcacccgctgacaccctacagcctggactcgaaaggagaaaagccgccgctctcgatcaaggggcgtcaggccgggcgaggttaccgtgactggctgggtctggtacttggtaatgaagatcaccagccggatgccgcgcaggttgttcggcacttcaccgccaaactgggcaagccgtccgtgcgcttgtggtgcttcggtttcgatatgtcgaacatgaaagcgttgtgctggtacgacagtctgttgccggtacacggcgtggcacctgacgttcagcggaagtttacccgcagcgtcaagcaggtgctggattcggccaatgacatggcctccgttctgcacaaacaggtcaaagcggcctggtttcgccgtccgggcgatgccggtcaggagcctgccgtgacgcaaagtttttggcagggctctgagacggccttttatcaggtgctggagcagctcagcaagctcgattttgacagcgcggccgagttggcagcgatctacagagcctggttgcaggccacgcgtcgtctggtgctaagtctgtttgaccactgggtgctgagcggtccgctggaagatatggacatgcaacgcgtggtcaaggcccgggctgatctggccaaagagctgaatactggcaaggcacaaaagccgctgtggacaatcgttaatcaacatctcaaggagcaggcatga

SEQ ID NO: 39 - DNA, 642 bp, Pseudomonas sp. S-6-2
  misc_feature (1)..(642): Cse2
atgaagccgagaaagcccagattgaacgaggcccagcagcgctgggtgcgcgactggtggcgcgccttgcagccccgcgccgagggtgatgaacccatacccggcgagctgtctgtcatggggaggggtgagcgggcacaactgcgccgctgcaccgatgccgatgagctgcttacccagtcagccaccctgctgctggcgcaccgtttggttgcactcaatggtgagcgaggccctttgcctgataattccttgagctacgagcgcatggcctgggtggccggggtgctggctaacgtcaaggacgacctgcgtgacggcaagagtctggctacgcaccttgggcaggctgctgatgccgagcgcccgccgatgagcgaactgcgtttcagggctatgcagcgcggcacggcgatgcaggagctattcctgcattggcgtcgggcgttgcaactggccgggggcaagactgatgtggcacacctggcagatgacctgctgagctggcagatagagcagggccagtctgctgctcaggcgagcaacggggtcaaatttcactgggcctatgactactatctgagcgcccgggaccgggcagccgccaaagaacctgaattcaacaaggagatatccaaatga

SEQ ID NO: 40 - DNA, 1035 bp, Pseudomonas sp. S-6-2
  misc_feature (1)..(1035): Cas7
atgactcgttttgtgcaattgcacctgctgacgtcctacccgcccgccaaccttaaccgcgatgatctgggcaacccgaaaaccgcacgcctaggcggtgttgaacgtctgcgtgtgtcctcgcaaagtctcaaacgcgcttggcgtacctcggagctgtttcagcaacagttggccgggactatcggcacgcgcaccaagcgccttggtatcgaggttttcgaggcactgctgggtgctggtgtcactgagaagcaggcgcgtgagtgggctggacaaatcgccaaggtttacggggctgcgaaaaaggataatccactggaaatcgagcagctggtccatatcgcgcctgaagagcgtgcttcgctggatcaactggtggccacccttgccgcggaaaaacgcggcccaacggatgaggagttggacgccctgctgcaccaccagacagcggtggatatcgccatgtttggtcgcatgctggcctccaaaacacagttcaacggagaggccgcagtgcaggtagcccatgccatcggcgtgcacgcatcggctattgaggatgactacttcaccgccgttgacgatctcaaccgcaatgatcctggcgctgcgcatatcggtgaatccggtttcgccgctgcagtgttctaccagtacatctgcatcgaccgcgatctgctgaaacggaatctggggggcgatgaagtgctgactcaaaaggcactccgggctctgactgaagcggcgctcaaagtggggcccagcggcaagcaaaacagcttcgccagccgggctttcgcccactttgcgctggccgagaaaggcactgatcagccgcgctctctgtcactggccttcgtcaaaccggtggccggcacagactatgccggtgatgccgttgcggccttgcaacaggtgcgcgacaacatggacaaggtctatggagtctgcgctgaaagccgctgccagttcaatgtgctgacgggtgaagggtcagtggccgacctgcttgattttgtcgccgcggagtga

SEQ ID NO: 41 - DNA, 768 bp, Pseudomonas sp. S-6-2
  misc_feature (1)..(768): Cas5
atgactgactatctactgctgcggctctatggcccgctggccagctggggcgagattgcagtcggcgaatcgcgacactcggcggtacaaccgtcgcgttccgcgctgcttggtttgctgggtgcagcgctgggtatcgagcggcacgatgatgccgctcagcaggcgcttgtggacggttaccgctttgcgatcaagctggaatgcataggttcgcccttgcgtgactatcacacggttcaggtaggcgtgccgccgcgcaagttccagtttcgctcacgtcgtcaggaattggctgccgacaaagtcgatactattctgtcgacccgtgagtaccgctgtgacagcctcgcgttggttgctgtggaagccttgcccggtgcgccggtggacttggcctccctggccgaagcgctgcgtaagccgcgcttcgccttgtatctggggcgcaaatcctgcccgcttgctttgccgttgagtccaaaaattcttgccgccagcagtgtgcgtgaggtgttcgacaatctggaattgccttccttgctgggtttgttggatcgctatcagcccgagcaagcctggccaagtcgacaggaccaacaggcactacgtcccggtgtcgcgcgatactattgggaagacgggatgactgctggcatggcgccgagctttgaggcccaacgacatgatcagccactctcccgtcgccgctggcagtttgcaccgcgccgcgaatgggtggccttgaatgatggagggcagtcatga

SEQ ID NO: 42 - DNA, 663 bp, Pseudomonas sp. S-6-2
  misc_feature (1)..(663): Cas6
atgagccattatttctcgcttgttagactgatcggcagtccgcgtcacgatgcctggctgcgtgacttgtcgcgccatggtgaagcctacagggatcatgcgttgatctggcgcctgttcccgggcgatggcgctgcacgtgactttgttttccgccgccttgaggacgaaaaaagtttctatgtggtttcagcacgaccaccacaggccgatgcggggttattccatatccagagcaaagcctattcgcctgagttggccgagggtgattgggtgcgattcgacctgcgtgccaatcccaccgtcagcgtgcgccgggaaaatggtcgctcacagcgtcatgatgtgctgatgcacgccaagcagcttgccagcacagaaaaatcggcactacctgagcggctggaagcagcaggcagggaatggctgaaagacagggcggaacgctggggactggatttgcgtactgacagtcttatgcaaaacggttatcgccagcagcggttgaagcgcaagggtaaacacatcgctttttccacgttggactatcagggcattgcccaggtgacggaccctgaacaattgcgccgggcactgctcgacggggttggacacagcaagggctttggctgcgggctgttgctggtaaaacgtgtggactga

SEQ ID NO: 43 - DNA, 1554 bp, Pseudomonas sp. S-6-2
  misc_feature (1)..(1554): Cas8
atggacctgctgtctgatacatggctgcagtgcaggcacagggacggcaccctgaagcctatcgccatcggccagatcggcctggaggactgtctggagctggtggcacctcggcccgacttccggggcgccctgtaccagttcctgatcggcctgctgcagacagcctatgccccagaggacctgcaggagtggagagatagatacgccaaccctccaaccgccgacgatctggccgaggtgtttgccccttatagggatgccttccagctggagaactccggcccaacattcatgcaggacctgaccctgccagacgatgtgaatcagctgcccgtgctggagctgctgatcgacgcaggctcctctagcaaccagtactttaataagccagcagtggagcacggaatgtgcgagggctgtttcacacaggccctgctgaccatgcagctgaatgcaccatccggcggaaggggcatcagaacatctctgaggggaggaggacctctgaccacactgctggtgccagccgagcagaacgccaccctgtggcagaagctgtggctgaatgtgctgcccctggacgccctggatcacccacctatcaagatgctgtctgatgtgctgccatggctggcaccaacccggacaagcgacgataagcagggccaggacacaccacccgagtctgtgcacccactgcaggcctactggagcatgcctaggcggatcagactggacgcagccaccctggaccagggcgattgcgccgtgtgcggagcacagaacgtgaagcgcatccggcactacagaacaaggcacggcggcaccaattataccggcacatggacccaccccctgaccccttattctctggatagcaagggcgagaagcctccactgagcatcaagggccggcaggcaggaaggggatacagggactggctgggactggtgctgggaaacgaggaccaccagcctgatgccgcccaggtggtgaggcacttcacagccaagctgggcaagccatccgtgcgcctgtggtgctttggcttcgacatgagcaatatgaaggccctgtgctggtacgattccctgctgccagtgcacggagtggcccctgacgtgcagaggaagtttacccgcagcgtgaagcaggtgctggactctgccaacgatatggccagcgtgctgcacaagcaggtgaaggccgcctggttcagaaggcccggcgacgcaggacaggagcctgcagtgacacagtctttttggcagggcagcgagaccgccttctatcaggtgctggagcagctgtccaagctggactttgattctgccgcagagctggcagcaatctacagagcatggctgcaggcaacccgccggctggtgctgagcctgttcgatcactgggtgctgtccggccctctggaggacatggatatgcagcgggtggtgaaggcaagagcagacctggccaaggagctgaacacaggcaaggcccagaagccactgtggaccatcgtgaatcagcacctgaaggagcaggcctaa

SEQ ID NO: 44 - DNA, 642 bp, Pseudomonas sp. S-6-2
  misc_feature (1)..(642): Cse2
atgaagccaaggaagcctcggctgaatgaggcccagcagagatgggtgagggattggtggagggccctgcagccaagggcagagggcgacgagccaatccctggagagctgagcgtgatgggaaggggagagagggcacagctgcggagatgtaccgacgccgatgagctgctgacacagtccgccaccctgctgctggcacacaggctggtggccctgaacggagagagaggaccactgcccgataatagcctgtcctatgagaggatggcatgggtggcaggcgtgctggcaaacgtgaaggacgatctgagagatggcaagtccctggccacccacctgggacaggcagcagacgcagagaggcctccaatgtctgagctgcgctttcgggccatgcagagaggcacagccatgcaggagctgttcctgcactggaggcgcgccctgcagctggcaggaggcaagaccgacgtggcacacctggcagacgatctgctgagctggcagatcgagcagggacagtctgccgcacaggccagcaatggcgtgaagtttcactgggcctacgactactatctgtctgccagagatagggccgccgccaaggagccagagttcaacaaggagatcagcaaataa

SEQ ID NO: 45 - DNA, 1035 bp, Pseudomonas sp. S-6-2
  misc_feature (1)..(1035): Cas7
atgacacgctttgtgcagctgcacctgctgacctcttatccccctgccaacctgaatagggacgatctgggaaaccctaagacagcaaggctgggaggagtggagagactgagggtgagctcccagtctctgaagcgcgcctggcggacaagcgagctgtttcagcagcagctggcaggaaccatcggaaccagaacaaagaggctgggcatcgaggtgttcgaggccctgctgggagcaggagtgaccgagaagcaggcaagggagtgggcaggacagatcgcaaaggtgtacggagccgccaagaaggataaccccctggagatcgagcagctggtgcacatcgcccctgaggagagggccagcctggaccagctggtggccacactggcagcagagaagagaggaccaaccgacgaggagctggatgccctgctgcaccaccagacagccgtggacatcgccatgtttggcaggatgctggccagcaagacccagttcaatggagaggcagcagtgcaggtggcacacgcaatcggagtgcacgcctccgccatcgaggacgattacttcaccgccgtggacgatctgaaccgcaatgatccaggagcagcacacatcggagagtccggctttgccgccgccgtgttctaccagtatatctgcatcgaccgggatctgctgaagagaaacctgggcggcgacgaggtgctgacacagaaggccctgcgcgccctgaccgaggccgccctgaaggtcggccccagcggcaagcagaattcctttgcctctagggcctttgcccacttcgccctggccgagaagggcacagatcagccacgctccctgtctctggccttcgtgaagccagtggcaggaaccgactacgcaggcgatgccgtggccgccctgcagcaggtgagggacaacatggataaggtgtatggcgtgtgcgccgagtcccgctgtcagtttaatgtgctgacaggagagggctctgtggcagacctgctggatttcgtggcagcagagtaa

SEQ ID NO: 46 - DNA, 768 bp, Pseudomonas sp. S-6-2
  misc_feature (1)..(768): Cas5
atgaccgactacctgctgctgaggctgtatggaccactggcatcctggggagagatcgcagtgggagagtctaggcacagcgccgtgcagccttctcgcagcgccctgctgggactgctgggagccgccctgggcatcgagagacacgacgatgcagcacagcaggccctggtggatggataccggttcgccatcaagctggagtgtatcggctctcccctgagagactatcacaccgtgcaagtgggagtgccaccaaggaagttccagtttagaagccggagacaggagctggcagcagacaaggtggatacaatcctgtccaccagagagtataggtgcgattctctggccctggtggcagtggaggccctgccaggagcacccgtggacctggccagcctggcagaggccctgcgcaagccaaggtttgccctgtacctgggaaggaagagctgtccactggccctgcctctgtccccaaagatcctggccgcctctagcgtgcgcgaggtgttcgataacctggagctgccttctctgctgggcctgctggacaggtaccagcctgagcaggcctggccaagcagacaggatcagcaggccctgaggccaggagtggcaaggtactattgggaggacggaatgacagcaggaatggcaccttcttttgaggcccagaggcacgatcagccactgagcaggcgccggtggcagttcgcaccaagaagggagtgggtggccctgaacgatggaggacagtcctaa

SEQ ID NO: 47 - DNA, 663 bp, Pseudomonas sp. S-6-2
  misc_feature (1)..(663): Cas6
atgtctcactacttcagcctggtgaggctgatcggctcccctaggcacgacgcctggctgagggatctgagcagacacggagaggcctacagggaccacgccctgatctggagactgttccctggcgacggagcagcaagggatttcgtgtttcgccggctggaggatgagaagtccttttatgtggtgtctgccaggccacctcaggcagacgcaggactgttccacatccagtccaaggcctactctccagagctggcagagggcgactgggtgaggttcgatctgcgcgccaaccccacagtgtctgtgagaagggagaatggcagaagccagaggcacgatgtgctgatgcacgccaagcagctggccagcaccgagaagtccgccctgcccgagcggctggaggcagcaggaagagagtggctgaaggacagggcagagcggtggggcctggacctgagaaccgattccctgatgcagaacggctacagacagcagaggctgaagcgcaagggcaagcacatcgccttttctacactggactatcagggcatcgcccaggtgaccgatcccgagcagctgcgccgggccctgctggacggagtgggacactccaagggattcggatgcggactgctgctggtgaagcgggtggattaa

SEQ ID NO: 48 - protein, 517 aa, Pseudomonas sp. S-6-2
  misc_feature (1)..(517): Cas8
MDLLSDTWLQCRHRDGTLKPIAIGQIGLEDCLELVAPRPDFRGALYQFLIGLLQTAYAPEDLQEWRDRYANPPTADDLAEVFAPYRDAFQLENSGPTFMQDLTLPDDVNQLPVLELLIDAGSSSNQYFNKPAVEHGMCEGCFTQALLTMQLNAPSGGRGIRTSLRGGGPLTTLLVPAEQNATLWQKLWLNVLPLDALDHPPIKMLSDVLPWLAPTRTSDDKQGQDTPPESVHPLQAYWSMPRRIRLDAATLDQGDCAVCGAQNVKRIRHYRTRHGGTNYTGTWTHPLTPYSLDSKGEKPPLSIKGRQAGRGYRDWLGLVLGNEDHQPDAAQVVRHFTAKLGKPSVRLWCFGFDMSNMKALCWYDSLLPVHGVAPDVQRKFTRSVKQVLDSANDMASVLHKQVKAAWFRRPGDAGQEPAVTQSFWQGSETAFYQVLEQLSKLDFDSAAELAAIYRAWLQATRRLVLSLFDHWVLSGPLEDMDMQRVVKARADLAKELNTGKAQKPLWTIVNQHLKEQA

SEQ ID NO: 49 - protein, 213 aa, Pseudomonas sp. S-6-2
  misc_feature (1)..(213): Cse2
MKPRKPRLNEAQQRWVRDWWRALQPRAEGDEPIPGELSVMGRGERAQLRRCTDADELLTQSATLLLAHRLVALNGERGPLPDNSLSYERMAWVAGVLANVKDDLRDGKSLATHLGQAADAERPPMSELRFRAMQRGTAMQELFLHWRRALQLAGGKTDVAHLADDLLSWQIEQGQSAAQASNGVKFHWAYDYYLSARDRAAAKEPEFNKEISK

SEQ ID NO: 50 - protein, 344 aa, Pseudomonas sp. S-6-2
  misc_feature (1)..(344): Cas7
MTRFVQLHLLTSYPPANLNRDDLGNPKTARLGGVERLRVSSQSLKRAWRTSELFQQQLAGTIGTRTKRLGIEVFEALLGAGVTEKQAREWAGQIAKVYGAAKKDNPLEIEQLVHIAPEERASLDQLVATLAAEKRGPTDEELDALLHHQTAVDIAMFGRMLASKTQFNGEAAVQVAHAIGVHASAIEDDYFTAVDDLNRNDPGAAHIGESGFAAAVFYQYICIDRDLLKRNLGGDEVLTQKALRALTEAALKVGPSGKQNSFASRAFAHFALAEKGTDQPRSLSLAFVKPVAGTDYAGDAVAALQQVRDNMDKVYGVCAESRCQFNVLTGEGSVADLLDFVAAE

SEQ ID NO: 51 - protein, 255 aa, Pseudomonas sp. S-6-2
  misc_feature (1)..(255): Cas5
MTDYLLLRLYGPLASWGEIAVGESRHSAVQPSRSALLGLLGAALGIERHDDAAQQALVDGYRFAIKLECIGSPLRDYHTVQVGVPPRKFQFRSRRQELAADKVDTILSTREYRCDSLALVAVEALPGAPVDLASLAEALRKPRFALYLGRKSCPLALPLSPKILAASSVREVFDNLELPSLLGLLDRYQPEQAWPSRQDQQALRPGVARYYWEDGMTAGMAPSFEAQRHDQPLSRRRWQFAPRREWVALNDGGQS

SEQ ID NO: 52 - protein, 220 aa, Pseudomonas sp. S-6-2
  misc_feature (1)..(220): Cas6
MSHYFSLVRLIGSPRHDAWLRDLSRHGEAYRDHALIWRLFPGDGAARDFVFRRLEDEKSFYVVSARPPQADAGLFHIQSKAYSPELAEGDWVRFDLRANPTVSVRRENGRSQRHDVLMHAKQLASTEKSALPERLEAAGREWLKDRAERWGLDLRTDSLMQNGYRQQRLKRKGKHIAFSTLDYQGIAQVTDPEQLRRALLDGVGHSKGFGCGLLLVKRVD

SEQ ID NO: 53 - DNA, 90 bp, Pseudomonas sp. S-6-2
  misc_feature (1)..(90): CRISPR
gtgttccccgcacctgcggggatgaaccgggccggggcgtttgcgctgtcaggggcgtcccgtgttccccgcacctgcggggatgaaccg

SEQ ID NO: 54 - DNA, 1536 bp, Salmonella enterica subsp. enterica serovar Muenster strain
  misc_feature (1)..(1536): Cas8
atggatttaaccaaagagaaatggcttcccgtcatattctcaaacggcgaaaaaacgagaatatcattacgcgatcttctggataaccgcattcaggatcttgcatacccccggcccgattttcagggggctgcatggcaaatgctgattggtattttacaatgtaccgtcgcgccggaagataaagaagaatgggcagatatctggcatgaaagtatcgaattcgaacaatgggagaaggcgttaaatacgatttctctggctctacagttcggcgagcaaaaaccttccttcctgcaaagttttgatcctctcgatagtgaatatggttctattgccgggctgctggtggatgcgccgggcggtaatgcgctcaagctcaataaagatcattttgtaaaacgtggcaacgtagaacaaatatgtcctcactgcgcggcgatagcgctatttgcgattcaaaccaattcacctgccggcggggcgggttaccgggtagggatgcgcggcggtggtccgctgactacgctggtggtaccgcaggaagaagataaatatccactatggaaaaaactttggcttaacgttttgccgcaggaagagccgccgaatgttacacagcatccactcatttttccctggcttgcgccgacgaaaaccagcgaaaaagcggggaatgtggtcacaccggataatgcgcaccccttgcaagcctactggggaatgccgcggcgcatagaactggatttcacccacactgtggcaggtatctgcgatttgtgcggggagcatcacgaatcactgctactgcaaatgcgtagtaaaaattatggcgttcagtacgacagttggttacatcctttctccccatatcggcaggcattgaaagatccatccgcaccctggctggcgtttaaagggcagccgggcgggttaagttataaagactggttggggctgatgctcaatcgtgaggataagttcaacaaaatgcagcctgcaaaggtcgttcgtgccgctggtcagcggaacaaaatgagcctgtggtgctttgcctgggatatggataaggccaaggtccgctgctggtatcagcaccgtattccgctcattagcgtttcgcacgaagagcaatttctcgctgtgcttaacattgtgctggtgctggctagtgagtcgctgtcgctgttacggaacgcgttaaagagcgccaaattcgattgtccgaaagaagccaaaatggattttagtatggtggatatcgccttctggcaggaaaccgaacccgcttttcggacgttgcaagaggcgctggctgtcgatccgcttcggcaggatacacagactcgtcacgcagtaagtcagtgggaggcggaattagcacactatctatttcacgtttttgatcgtgatgccctgaccaaccccgactgcccggacgatatcctgcagcgccagctgacggcccgacaggatttagccagcagctatcgtaaacataaagcgcgcaaggatgtgttggcgctggtcgaataa

SEQ ID NO: 55 - DNA, 603 bp, Salmonella enterica subsp. enterica serovar Muenster strain
  misc_feature (1)..(603): Cse2
atgctgaatagcaatacagcagtgttatgcagaattctccaccccgatgcgcagaaggcgctacttgactggtttgctacgctgtctgagcgttacgagcgcaaggatggtaaacgagtcaacggtcgcgcctggcgggctgagttgaaaagaatggcgccgccatatggcgtaatgatatgtgaagggcatgacgctctccgccaggcgctgcttaaacatatgcgactgcaacctcttgatgagatggctctggcgctgtttgtcagcgtcgctgtgcatattaagagccataaggcgaatattagtttcgctgcacaattaggggaaaagcttaaaggttctacgccgtgcgtttctgttctgcgttttgaacgtttgcaaaaagcgtccgacccggaaacattttgccagttgttgattcaggcagtgaagattcgcggtacggagggggtgaatgttctttcacttgccgatggcattttcctgtggatggaagagtggcaacgacgcgaaaaccatcagccggaattccgtaacccctttgaacgaaatcgcatccgttgggcgaacgaatatctttccacgtcgcgtggcaaataa

SEQ ID NO: 56 - DNA, 1065 bp, Salmonella enterica subsp. enterica serovar Muenster strain
  misc_feature (1)..(1065): Cas7
ttgataatgacaacttttattcaactgcatttattgactgcttatgcgcccgctaacctgaatcgtgatgagtctggcagaccgaagaccgcgtttatgggaggagttgagcgtttacgcgtatcgtcgcaaagtctgaagcgtgcctggcgggtgtcggaaacttttgaagcggcaatggatggttttatgggtaagcgtactcgtcgaattggcgtggattatgtttatcgtccgatgaaagatgccggaattgaagaaaaaattgctaagagttcgtctgagttaatcgctaagcaatttggcaagcttaaaagtgataaagatgcgaaaccggaaaaaaatctcgaaattgagcagatcgttcacgtcagtaaccatgaaattagtttgattaagcaactggttgatacgctaattgccgacaaacgcgaacctaacgatgaagaagtggagttgttgcgcaaagagcagcgtagcgtagatatggcgctgtttggccgtatgctggcgtcatcgcctgagttcaacgtcgaggctgcttgtcaggtatcccatgcgttgggcgtaagtgccgtgaccgttgagtctgattttttcaccgccgttgacgatctgaataataaagaggaagacgcaggttccgggcatatgggcgagcagggttttgcctcggcgcttttctatacctatgtctgtatcagccgcgatctgctggtggaaaacctgggtggtaacgaagaactggcgaagcgtactatcgcggcactcactgaaacagcgttaaccgtctcgccaaccggtaaacaaaacagcttcgcttctcgtgcctatgccacctatgcgttggccgaagtcgggcaaaaacaaccgcgttctctggcggcggcatttttccagccggtacgcgataccgatcaaattccggcggcaataacccgtttaaaacagcagcgcgccagcttcgataacgtatacggaaactgtgcagacgattatcgcgagttgaacgttcaggaaggtacgggatctctggcggaattactggcctttgttagccagtaa

SEQ ID NO: 57 - DNA, 726 bp, Salmonella enterica subsp. enterica serovar Muenster strain
  misc_feature (1)..(726): Cas5
atgaaggaatatctggtttttcagctctatgcgccgctggcgtcgtggggggaagaagcgtctggcgagattcgccactcagctacggttcccacgcgctctgcgctattgggtctgcttgccgcagcgttaggaattcgtcgcgacgaagaagcgcggctgaataactttaaccggcactatcatctggcggtgcacgcgttggcttcacaagatcgctggttgcgggattatcacacggttagcgcgccgcgagaaaacaaaaagaatcgttattacacgcgccgggatgaactgactctcgcgccggatgaagtggggacgcttatctcgcagcgagaatatcgctgcgacggctactggcatgtggcaataagcgccacgcctgatgcaccacattcgcttagcgaattgcgagaggcgctgctgacaccgcattttccgctctatctggggagaaaatcctgcccgctggcgttaccgttagcggcgcgtttaatgaccggcaccttaaaagaggtattcacccatgctgtggaggagatttccgcagcggaattaagtggatttaccctgcgtgagggtatttgttattgggatgatcctgatgaggagagtctggtctggcaacaaaagcagcatagcaataaccagccagttagccgccaacgctggcagtttggcggctacacccgcttcaatgggccgttgcaggagagaacataa

SEQ ID NO: 58 - DNA, 705 bp, Salmonella enterica subsp. enterica serovar Muenster strain
  misc_feature (1)..(705): Cas6
atgtatctttctcgtattcaactccggtttaataatttgcgaccggagatgttggcaaagtggaattcagccaggccttatgccagccaccagtggttatggcagctctttccggaacaggaattgcgtcagtttctgtttcgcgaagaggcgcatggcggcttttttatgctctcggcaataccgccgttatcgcagcactccctgtttcttattgaaaccaaaccatttaatccgcaactgacaaatggtcttgagcttgattttcaactacgagctaacccggtgataacccgtaacggtaagcgcagtgacgtgatgatgaacgcgaaacatcaggcgaaggcgaatggtgtggagaaagaacggtggtgggagcttcaacagcaggccgcgcaggcgtggctggaacaacaagggcagcagcatggtttccggttgattgcaccggaacctgatgatttcgctatgtgggctggtgacgagtacagtgaattgcaggcacattgtggatgcgtgcaagcgtatcagcagcatcgttttgtccgtaaagaccagcaaaaaccgatcactttcagtagcgttgattttagcggtgcgctctgtatcaccgatgcagcactgtttaaacaggctttattttccggattaggtaaaagtaaagcgctgggctgcggaatgctgatggtaaaaaggaaacgctga

SEQ ID NO: 59 - DNA, 1536 bp, Salmonella enterica subsp. enterica serovar Muenster strain
  misc_feature (1)..(1536): Cas8
atggacctgaccaaagagaagtggctgcctgtgatcttttctaacggcgagaagacaagaatcagcctgagggacctgctggataatcgcatccaggacctggcctatcctcggccagatttccagggagcagcatggcagatgctgatcggcatcctgcagtgtaccgtggccccagaggacaaggaggagtgggccgatatctggcacgagtctatcgagtttgagcagtgggagaaggccctgaacacaatcagcctggccctgcagttcggcgagcagaagccctcttttctgcagagcttcgaccctctggattccgagtacggctctatcgcaggactgctggtggacgcaccaggaggcaacgccctgaagctgaataaggatcactttgtgaagagaggcaacgtggagcagatctgcccacactgtgcagcaatcgccctgttcgccatccagaccaatagccctgcaggaggagcaggctatagggtgggaatgaggggaggaggaccactgaccacactggtggtgcctcaggaggaggacaagtacccactgtggaagaagctgtggctgaacgtgctgccacaggaggagccccctaatgtgacccagcacccactgatctttccctggctggcccctaccaagacatccgagaaggccggcaacgtggtgacacctgataatgcccacccactgcaggcctactggggaatgccaaggaggatcgagctggacttcacccacacagtggcaggaatctgcgacctgtgcggagagcaccacgagtccctgctgctgcagatgcgctctaagaactacggcgtgcagtatgactcttggctgcacccctttagcccttataggcaggccctgaaggacccctccgccccatggctggccttcaagggacagccaggaggactgtcttacaaggactggctgggcctgatgctgaacagggaggataagtttaataagatgcagccagcaaaggtggtgcgcgcagcaggccagcggaataagatgagcctgtggtgcttcgcctgggacatggataaggccaaggtgcgctgttggtaccagcacagaatccccctgatctccgtgtctcacgaggagcagttcctggccgtgctgaacatcgtgctggtgctggccagcgagtccctgtctctgctgcggaatgccctgaagagcgccaagtttgactgccctaaggaggccaagatggacttttccatggtggatatcgccttctggcaggagaccgagcctgccttcagaacactgcaggaggccctggcagtggacccactgagacaggatacccagacaaggcacgccgtgagccagtgggaggcagagctggcccactatctgtttcacgtgttcgaccgcgatgccctgaccaaccctgattgtccagacgatatcctgcagagacagctgacagcaaggcaggacctggcaagctcctacaggaagcacaaggcccggaaggatgtgctggccctggtggagtaa

SEQ ID NO: 60 - DNA, 603 bp, Salmonella enterica subsp. enterica serovar Muenster strain
  misc_feature (1)..(603): Cse2
atgctgaacagcaataccgccgtgctgtgcagaatcctgcaccctgacgcccagaaggccctgctggattggttcgccacactgagcgagcggtacgagcggaaggacggcaagcgcgtgaacggaagagcatggagggcagagctgaagaggatggcaccaccctacggcgtgatgatctgtgagggacacgacgccctgagacaggccctgctgaagcacatgaggctgcagcctctggatgagatggcactggccctgttcgtgagcgtggcagtgcacatcaagtctcacaaggccaacatcagcttcgccgcacagctgggagagaagctgaagggctccaccccatgcgtgtctgtgctgcgctttgagcggctgcagaaggccagcgaccccgagaccttctgtcagctgctgatccaggccgtgaagatcaggggcacagagggcgtgaatgtgctgtccctggccgatggcatcttcctgtggatggaggagtggcagaggcgcgagaaccaccagccagagtttcgcaaccccttcgagaggaatcgcatccggtgggccaatgagtacctgtctaccagccgcggcaagtaa

SEQ ID NO: 61 - DNA, 1065 bp, Salmonella enterica subsp. enterica serovar Muenster strain
  misc_feature (1)..(1065): Cas7
atgatcatgaccaccttcatccagctgcacctgctgaccgcatacgcacctgccaacctgaatagagacgagagcggcaggccaaagacagccttcatgggaggagtggagcggctgagagtgagctcccagagcctgaagagagcctggagggtgtccgagacctttgaggccgccatggatggcttcatgggcaagagaacacggagaatcggcgtggactacgtgtataggcctatgaaggatgccggcatcgaggagaagatcgccaagtctagctccgagctgatcgccaagcagttcggcaagctgaagagcgacaaggatgccaagccagagaagaacctggagatcgagcagatcgtgcacgtgagcaatcacgagatctccctgatcaagcagctggtggacaccctgatcgccgataagagggagccaaacgacgaggaggtggagctgctgcgcaaggagcagcggtccgtggatatggccctgtttggccgcatgctggcctctagccccgagttcaatgtggaggcagcatgccaggtgtctcacgccctgggcgtgagcgccgtgaccgtggagtccgacttctttacagccgtggacgatctgaacaataaggaggaggatgcaggctccggccacatgggagagcagggatttgcctctgccctgttctacacctacgtgtgcatcagccgcgacctgctggtggagaacctgggaggcaatgaggagctggccaagcggacaatcgccgccctgaccgagacagccctgaccgtgagccctacaggcaagcagaacagctttgcctcccgcgcatacgcaacctatgccctggcagaagtgggacagaagcagccacgctccctggcagcagccttctttcagcccgtgcgggacaccgatcagatccctgccgccatcacacgcctgaagcagcagcgggcctcttttgacaacgtgtacggcaattgcgccgacgattatagggagctgaacgtgcaggagggaaccggctccctggcagagctgctggccttcgtgtctcagtaa

SEQ ID NO: 62 - DNA, 726 bp, Salmonella enterica subsp. enterica serovar Muenster strain
  misc_feature (1)..(726): Cas5
atgaaggagtacctggtgtttcagctgtatgcacctctggcaagctggggagaggaggcctccggcgagatcagacactctgccaccgtgccaacaaggtccgccctgctgggactgctggcagccgccctgggcatccggcgggatgaggaggccagactgaacaatttcaataggcactaccacctggcagtgcacgccctggcatcccaggacagatggctgagggattatcacaccgtgtctgccccccgcgagaacaagaagaatcggtactataccaggagggacgagctgacactggcccctgatgaagtgggcacactgatctctcagcgcgagtaccggtgcgacggctattggcacgtggcaatcagcgccacccccgatgcacctcactccctgtctgagctgcgggaggccctgctgacaccacacttccccctgtacctgggcagaaagagctgtccactggccctgcctctggcagcaaggctgatgaccggcacactgaaggaggtgtttacccacgcagtggaggagatcagcgccgcagagctgtccggcttcacactgagagagggcatctgctattgggacgatcctgacgaggagtccctggtgtggcagcagaagcagcacagcaacaatcagccagtgtccagacagaggtggcagtttggcggctacaccaggttcaacggaccactgcaggagaggacataa

SEQ ID NO: 63 - DNA, 705 bp, Salmonella enterica subsp. enterica serovar Muenster strain
  misc_feature (1)..(705): Cas6
atgtatctgagcagaatccagctgaggtttaacaatctgagacccgagatgctggccaagtggaactccgccaggccttacgcctctcaccagtggctgtggcagctgttccctgagcaggagctgagacagttcctgtttagggaggaggcccacggcggcttctttatgctgagcgccatcccacccctgtcccagcactctctgtttctgatcgagaccaagcctttcaacccacagctgacaaatggcctggagctggactttcagctgagagccaaccccgtgatcacccgcaatggcaagcggtccgatgtgatgatgaacgccaagcaccaggccaaggccaatggcgtggagaaggagcggtggtgggagctgcagcagcaggcagcacaggcctggctggagcagcagggccagcagcacggctttagactgatcgccccagagcccgacgatttcgccatgtgggcaggcgacgagtacagcgagctgcaggcacactgcggatgcgtgcaggcctatcagcagcacagattcgtgaggaaggatcagcagaagccaatcaccttttcctctgtggacttctccggcgccctgtgcatcacagatgccgccctgtttaagcaggccctgttctccggcctgggcaagtctaaggccctgggctgcggcatgctgatggtgaagaggaagagataa

SEQ ID NO: 64 - protein, 511 aa, Salmonella enterica subsp. enterica serovar Muenster strain
  misc_feature (1)..(511): Cas8
MDLTKEKWLPVIFSNGEKTRISLRDLLDNRIQDLAYPRPDFQGAAWQMLIGILQCTVAPEDKEEWADIWHESIEFEQWEKALNTISLALQFGEQKPSFLQSFDPLDSEYGSIAGLLVDAPGGNALKLNKDHFVKRGNVEQICPHCAAIALFAIQTNSPAGGAGYRVGMRGGGPLTTLVVPQEEDKYPLWKKLWLNVLPQEEPPNVTQHPLIFPWLAPTKTSEKAGNVVTPDNAHPLQAYWGMPRRIELDFTHTVAGICDLCGEHHESLLLQMRSKNYGVQYDSWLHPFSPYRQALKDPSAPWLAFKGQPGGLSYKDWLGLMLNREDKFNKMQPAKVVRAAGQRNKMSLWCFAWDMDKAKVRCWYQHRIPLISVSHEEQFLAVLNIVLVLASESLSLLRNALKSAKFDCPKEAKMDFSMVDIAFWQETEPAFRTLQEALAVDPLRQDTQTRHAVSQWEAELAHYLFHVFDRDALTNPDCPDDILQRQLTARQDLASSYRKHKARKDVLALVE

SEQ ID NO: 65 - protein, 200 aa, Salmonella enterica subsp. enterica serovar Muenster strain
  misc_feature (1)..(200): Cse2
MLNSNTAVLCRILHPDAQKALLDWFATLSERYERKDGKRVNGRAWRAELKRMAPPYGVMICEGHDALRQALLKHMRLQPLDEMALALFVSVAVHIKSHKANISFAAQLGEKLKGSTPCVSVLRFERLQKASDPETFCQLLIQAVKIRGTEGVNVLSLADGIFLWMEEWQRRENHQPEFRNPFERNRIRWANEYLSTSRGK

SEQ ID NO: 66 - protein, 354 aa, Salmonella enterica subsp. enterica serovar Muenster strain
  misc_feature (1)..(354): Cas7
MIMTTFIQLHLLTAYAPANLNRDESGRPKTAFMGGVERLRVSSQSLKRAWRVSETFEAAMDGFMGKRTRRIGVDYVYRPMKDAGIEEKIAKSSSELIAKQFGKLKSDKDAKPEKNLEIEQIVHVSNHEISLIKQLVDTLIADKREPNDEEVELLRKEQRSVDMALFGRMLASSPEFNVEAACQVSHALGVSAVTVESDFFTAVDDLNNKEEDAGSGHMGEQGFASALFYTYVCISRDLLVENLGGNEELAKRTIAALTETALTVSPTGKQNSFASRAYATYALAEVGQKQPRSLAAAFFQPVRDTDQIPAAITRLKQQRASFDNVYGNCADDYRELNVQEGTGSLAELLAFVSQ

SEQ ID NO: 67 - protein, 241 aa, Salmonella enterica subsp. enterica serovar Muenster strain
  misc_feature (1)..(241): Cas5
MKEYLVFQLYAPLASWGEEASGEIRHSATVPTRSALLGLLAAALGIRRDEEARLNNFNRHYHLAVHALASQDRWLRDYHTVSAPRENKKNRYYTRRDELTLAPDEVGTLISQREYRCDGYWHVAISATPDAPHSLSELREALLTPHFPLYLGRKSCPLALPLAARLMTGTLKEVFTHAVEEISAAELSGFTLREGICYWDDPDEESLVWQQKQHSNNQPVSRQRWQFGGYTRFNGPLQERT

SEQ ID NO: 68 - protein, 234 aa, Salmonella enterica subsp. enterica serovar Muenster strain
  misc_feature (1)..(234): Cas6
MYLSRIQLRFNNLRPEMLAKWNSARPYASHQWLWQLFPEQELRQFLFREEAHGGFFMLSAIPPLSQHSLFLIETKPFNPQLTNGLELDFQLRANPVITRNGKRSDVMMNAKHQAKANGVEKERWWELQQQAAQAWLEQQGQQHGFRLIAPEPDDFAMWAGDEYSELQAHCGCVQAYQQHRFVRKDQQKPITFSSVDFSGALCITDAALFKQALFSGLGKSKALGCGMLMVKRKR

SEQ ID NO: 69 - DNA, 90 bp, Salmonella enterica subsp. enterica serovar Muenster strain
  misc_feature (1)..(90): CRISPR
gtgttccccgcgccagcggggataaaccgcagctttagcatcggtcgacagcccatctggcgtgttccccgcgccagcggggataaaccg

SEQ ID NO: 70 - DNA, 1518 bp, Atlantibacter hermannii NBRC 105704
  misc_feature (1)..(1518): Cas8
atggatttacttgttgatccatggatccctgtccgtgcgtttgaggagaggcatccacaaactattacgctacaacgattatgttgcagcgaagaaaaatggctattaaacctaccgcgcgatgacatggagctggcggccttacaattactgatctgcctgctgcaggtcacctgcgagccacgagatgacagcgaaatgcgcctaagggttgccaggccactttccgaagaagagttcgcagcattaatgtcaccctggcaccaaaccttccaacttgatcatccgcaaatgccttttatgcaggtaaaaggcgtggaagcgaaagagcccactccgatggaaaagctgatgaccggtttaagcggggcgacaaattgcgctttcgttaatcagccagggcagggcgaagcgttatgcggtggttgtacggcgatagcgctgtttaatcaggcaaataacgccccaggttttggaggcggttttaagagtggattacggggcggtacgccgattactactttaattaaaggctcagatctgcgtaccactatctggctaaatgtcctgaccacaccgcgtcttcaatcctctttcccgccagatagacttaccgaaaatcttcccacctggaaacgccctatatccagtggaaaaacatttcctgccgccacgattggtttactgcgcgggcttttttggcaacccgcacacattgaactttgcccgcctataggcccggggcaatgttgcgggtgcggacagcagagcaaccagcgttataacggttttctcaaggctaaattcaactttacggttgaaggattatggcctcatccacattccccgcgcgttctggttgagaaaaaaggcgttattgaacaaaagtttctcgcctttaccaccgcagcgccttcatggacgcaaataggtcgcctactggtggacaaagaaacccggcaaggtgaagggcgtcgggtggcgacggtggttgaacaattcagggaggtgtacccgcgcttcaggctggcattgatcgtcggtggatatcgtaataatcaggcttctattctggagcgtcgccacgatgtgctggttttcaatgatggatggcaaaacggtagcgatgtgatcaatgacattgttgaaatggggctgggatacaaaactgctttgcgaaaagggttgtacaccttcgttgagggggcaaaaaatcacgatgttaaaggggcgggtgtagcggtacacgaagtggctgaacgacattattaccgccgcagcgaactgcttattcccgcgatcctggcaagcattgattattctcagccaaatgatgtcattgcacgtctgagaaaagagcttcatcaactttgcgaagcgctcttcaaccaggttactgccccatatgcccatcatcccaaattgatccgctcattagcagtggcgcgcgcttcgcttcataaacatctcaatgaacttaaaccacaaggagagttagcgtatgtcgacggagattga

SEQ ID NO: 71 - DNA, 492 bp, Atlantibacter hermannii NBRC 105704
  misc_feature (1)..(492): Cse2
atgtcgacggagattgatgcaatggcgctctataacgcctggcagcaattagataacggctcaagtgcccagctaagacgggtaagcgagcctgatgagttacgcgagatccccgccttttatcgtctcgtccaaccctttggctgggagaatcctgccaataagcgtccgttactgcgtatggttttttgcctgagcgcgggtaaagacgtcattcatcataaagagaaaatcgatgattatccgtcaggcattagcctcggaagagcgctggcaaagagtggaaagattaacgaacgccgcgtttttcagcttgtccgtgcacagagtcccggcgacatgattcaactgcgacggttattaattcatgcagagcctgttcttgactggtctttattcgcccggcaactcacctggtggggcaaacgagagcgccagcaactgctggaagattttatgttggctacccctgaatcaaacaaaaaagcgtaa

SEQ ID NO: 72 - DNA, 1098 bp, Atlantibacter hermannii NBRC 105704
  misc_feature (1)..(1098): Cas7
atgaacaactttatcaactttcatgtcctgatttctcacagcccttcttgcctgaaccgcgacgatatgaatatgcaaaaagacgcggttttcggcggcaagcggcgtgtgcgtatttcgagccagagcttaaaacgtgcgatgcgcaaaagtgattactatgcccgtcatattggcgcatccagtcttcgcactatccatcttgaagagctgcgtgacgtattacgtcaaaaattatccccgcgattcgaattgccgataatcgataaaacgctgtctttgttatcaggaaaaaccattgatgatgctgaaaaaattaacggcgacgcagtaacgccttgggtattgggcgaagtcgaatggttttgcgaacaggtaatgaaagcggaagctgagcaactggatgataaaaaactgctcaaaatgcttaaagatgatattgccgcgatgcgcaccaatcttcagcagggggttgatgttgcactgagcggacgcatggcgaccagcggcctgatgagcgaactcgggaaagttgatggtgcaatgtccattgctcatgccatcaccacacatactgttgattccgatattgactggtttacagcagtagacgatctccaggacttaggttcggcgcaccttggaacccaggaattttcttccggcgtgttttatcgctacgccagtctgaatattgcccagcttcaggagaaccttggcggtgtatctcgcgagcaggtccttgaaatcgcagcgcatcttgcgcatatgctggcgactgaagtaccgggcgcgaagcaacataccttcgcggcattcaacccggcggacatggtcatgatcaatttttctgatttccccctttcgttagccaatgcttttgaaagcccgattaaagccaaagatggctatttgttaccttctatcaacgcctttaatgagtactggcagcgtatagctaaagggtatggattaacaggaccggcggcacagtttatgttggccgaagcaagtatggcgggcggaaatgtggtgtctgttgagacactggaacaacttaaaaaatggatttgccatgatggcgaggcgtcaagatga

SEQ ID NO: 73 - DNA, 675 bp, Atlantibacter hermannii NBRC 105704
  misc_feature (1)..(675): Cas5
atgaaaccctacttaatcctgcggcttgcgggaccgatgcaggcgtgggggcaaccaacatttgagggcacacgaccgacagcgcgcttccccacacgcagcggccttcttgggttgctgggcgcttgcctgggcattcaacgagacgaccgctcagcgttacaggcgctctctgaaagcgtcaggtttgcggttcgttgcgaccagtcatttattgatgggcgaaccattcccgttaccggcttgcgtgattaccatacggttatggatgcacgagaggattatcgtggcttaaaaagccacgaaaccattcagacctggcgcgaatacttgtgtgacgcggttttcaccgtggcggtatgggagtctgaacaggcaactctcaggctcccggagctgaaagttgcggtatgcaaacctcgttttacgccttttttgggacgtaaaagctgcccgttaacacagccgctctttgttgatctttgtgatgccatcaatccgtatcaggcgttggcaaattatgctccagcaggaggagatatttatagcgaagcgccgcctgacggaccgtgccaaacattcaccgtacgtgatgagccgattattgccttaccgcgacaatttgccgccagggagtggtacgtcataaaaggagcctcggatgtatctcagtaa

SEQ ID NO: 74 - DNA, 600 bp, Atlantibacter hermannii NBRC 105704
  misc_feature (1)..(600): Cas6
atgtatctcagtaaggtcattattcagaacgcctggtgccgggatgtttatcaatttcatcaggctatctggcagctttttccttctcaacctgcccaaaaaagagcgtttttatttcgtattgaggctaaacatcccggcagaggcgctgatgtattacttcaatcgatggaagcccctgcttcatcggctgccgcgcaagttcttgcctgtaaacctttagcatttcacctaaaagagggggatcagttgcgcttccgtctgcgtgccaacccaataaaaacgattaaagatgagcaacaacgtctgaatggtcgtggggaaatcaaacgctgccgtgtgccactacttaaagagcaggaacaacaccagtggttaatacgaaaattatcacttgcggctcgtctggaacatattgaatccactagtgagcttccgttgtttttttctaaaaatggtacgggtgggaaaattcagcccatgaattttgaaggcattcttaccgtaaccagtgtgccggcattgctgtcgctattaaataatggagtgggtccggcaaaagcaatgggatgtgggctgttatcacttgcccgcccctga

SEQ ID NO: 75 - DNA, 1518 bp, Atlantibacter hermannii NBRC 105704
  misc_feature (1)..(1518): Cas8
atggatctgctggtggacccatggattcccgtgcgggcctttgaggagaggcaccctcagaccatcacactgcagcggctgtgctgttccgaggagaagtggctgctgaatctgccaagagacgatatggagctggccgccctgcagctgctgatctgcctgctgcaggtgacctgtgagcctagggacgattctgagatgaggctgcgggtggcaaggccactgtctgaggaggagttcgccgccctgatgagcccttggcaccagacatttcagctggaccaccctcagatgccattcatgcaggtgaagggcgtggaggccaaggagccaacccccatggagaagctgatgaccggcctgagcggcgccacaaactgtgcctttgtgaatcagccaggacagggagaggccctgtgcggaggatgtacagcaatcgccctgttcaaccaggcaaacaatgcaccaggatttggaggaggcttcaagagcggcctgaggggaggaacccctatcaccacactgatcaagggctccgatctgcgcaccacaatctggctgaacgtgctgaccacaccccggctgcagtcctcttttcctccagacagactgaccgagaatctgcccacatggaagaggcctatcagctccggcaagacctttcctgcagcaacaatcggactgctgaggggactgttctggcagcctgcacacatcgagctgtgcccacctatcggaccaggacagtgctgtggatgtggacagcagtccaaccagcggtacaatggcttcctgaaggccaagtttaatttcacagtggagggactgtggcctcacccacactcccccagagtgctggtggagaagaagggcgtgatcgagcagaagtttctggccttcaccacagccgccccttcttggacccagatcggcaggctgctggtggataaggagacccgccagggagagggcaggcgcgtggccacagtggtggagcagtttcgggaggtgtaccctagattcaggctggccctgatcgtgggcggctatagaaacaatcaggccagcatcctggagcggagacacgatgtgctggtgtttaacgacggctggcagaatggctccgatgtgatcaacgacatcgtggagatgggcctgggctacaagaccgccctgaggaagggcctgtatacattcgtggagggcgccaagaatcacgacgtgaagggagcaggagtggcagtgcacgaggtggccgagcgccactactataggcgcagcgagctgctgatcccagcaatcctggcctccatcgattattctcagcctaacgacgtgatcgcaaggctgcggaaggagctgcaccagctgtgcgaggccctgttcaatcaggtgaccgcaccatacgcacaccacccaaagctgatccggtctctggcagtggcaagagccagcctgcacaagcacctgaacgagctgaagccacagggagagctggcatacgtggatggcgactaa

SEQ ID NO: 76 - DNA, 492 bp, Atlantibacter hermannii NBRC 105704
  misc_feature (1)..(492): Cse2
atgagcaccgagatcgatgccatggccctgtataacgcctggcagcagctggacaatggcagctccgcccagctgaggcgcgtgagcgagcctgatgagctgagggagatcccagccttttaccgcctggtgcagccattcggctgggagaaccccgccaataagcgccctctgctgcggatggtgttttgcctgtccgccggcaaggacgtgatccaccacaaggagaagatcgacgattacccatccggcatctctctgggacgggccctggcaaagtctggcaagatcaacgagcggagagtgttccagctggtgagagcccagagcccaggcgatatgatccagctgaggcgcctgctgatccacgcagagcccgtgctggactggagcctgtttgcaaggcagctgacctggtggggcaagagggagagacagcagctgctggaggatttcatgctggccacacccgagagcaacaagaaggcataa

SEQ ID NO: 77 - DNA, 1098 bp, Atlantibacter hermannii NBRC 105704
  misc_feature (1)..(1098): Cas7
atgaacaacttcatcaacttccacgtgctgatctctcacagcccatcctgcctgaaccgggacgatatgaatatgcagaaggatgccgtgttcggcggcaagcggagagtgagaatcagctcccagtccctgaagagagccatgaggaagtctgactactatgcaaggcacatcggagcatctagcctgcgcacaatccacctggaggagctgagagatgtgctgaggcagaagctgtcccctcgctttgagctgccaatcatcgacaagaccctgtccctgctgtctggcaagacaatcgacgatgccgagaagatcaacggcgacgcagtgaccccatgggtgctgggagaggtggagtggttctgtgagcaggtcatgaaggccgaggccgagcagctggacgataagaagctgctgaagatgctgaaggacgatatcgccgccatgaggaccaatctgcagcagggagtggatgtggccctgagcggcaggatggccacatctggcctgatgagcgagctgggcaaggtggacggagcaatgtccatcgcacacgccatcaccacacacaccgtggactctgatatcgactggtttacagccgtggacgatctgcaggatctgggctccgcccacctgggaacccaggagttttcctctggcgtgttctacagatatgcctccctgaacatcgcccagctgcaggagaatctgggaggcgtgtctcgcgagcaggtgctggagatcgcagcacacctggcacacatgctggcaaccgaggtgccaggagcaaagcagcacacatttgccgccttcaaccccgccgatatggtcatgatcaacttcagcgacttcccactgtccctggccaacgcctttgagagccccatcaaggccaaggacggctacctgctgccttccatcaacgccttcaatgagtactggcagcggatcgccaagggatatggactgaccggaccagcagcacagttcatgctggcagaggccagcatggcaggaggaaacgtggtgtccgtggagaccctggagcagctgaagaagtggatctgccacgatggagaggccagccggtaa

SEQ ID NO: 78 - DNA, 675 bp, Atlantibacter hermannii NBRC 105704
  misc_feature (1)..(675): Cas5
atgaagccatatctgatcctgagactggcaggaccaatgcaggcctggggacagcctacctttgagggcaccagaccaacagcaaggttcccaacacgctccggcctgctgggactgctgggagcatgcctgggcatccagagggacgatcggtctgccctgcaggccctgtctgagagcgtgcggtttgccgtgagatgtgatcagagcttcatcgacggccggaccatccctgtgacaggcctgagagattaccacaccgtgatggatgccagggaggactatcgcggcctgaagtctcacgagaccatccagacatggagggagtacctgtgcgacgccgtgtttaccgtggccgtgtgggagagcgagcaggccacactgaggctgccagagctgaaggtggccgtgtgcaagccccggtttacccctttcctgggcagaaagtcctgcccactgacacagcccctgttcgtggacctgtgcgacgccatcaacccttaccaggccctggcaaattatgcacctgcaggaggcgatatctattctgaggcacctccagacggaccatgccagacctttacagtgcgggacgagcctatcatcgccctgccaaggcagttcgcagcaagggagtggtacgtgatcaagggagcaagcgacgtgagccagtaa

SEQ ID NO: 79 - DNA, 600 bp, Atlantibacter hermannii NBRC 105704
  misc_feature (1)..(600): Cas6
atgtacctgagcaaagtgatcatccagaatgcctggtgtcgcgacgtgtaccagtttcaccaggccatctggcagctgttcccctctcagcctgcccagaagcgggccttcctgtttagaatcgaggcaaagcacccaggaaggggagcagacgtgctgctgcagagcatggaggcaccagcatctagcgccgcagcacaggtgctggcctgcaagcccctggcctttcacctgaaggagggcgatcagctgaggttccgcctgagggccaacccaatcaagaccatcaaggacgagcagcagcggctgaatggcagaggcgagatcaagagatgtagggtgcccctgctgaaggagcaggagcagcaccagtggctgatcaggaagctgtccctggcagcacgcctggagcacatcgagtccacctctgagctgcccctgttcttttctaagaacggcacaggcggcaagatccagcctatgaatttcgagggcatcctgaccgtgacaagcgtgcctgccctgctgtccctgctgaacaatggagtgggaccagcaaaggcaatgggatgcggcctgctgtctctggcaaggccataa

SEQ ID NO: 80 - protein, 505 aa, Atlantibacter hermannii NBRC 105704
  misc_feature (1)..(505): Cas8
MDLLVDPWIPVRAFEERHPQTITLQRLCCSEEKWLLNLPRDDMELAALQLLICLLQVTCEPRDDSEMRLRVARPLSEEEFAALMSPWHQTFQLDHPQMPFMQVKGVEAKEPTPMEKLMTGLSGATNCAFVNQPGQGEALCGGCTAIALFNQANNAPGFGGGFKSGLRGGTPITTLIKGSDLRTTIWLNVLTTPRLQSSFPPDRLTENLPTWKRPISSGKTFPAATIGLLRGLFWQPAHIELCPPIGPGQCCGCGQQSNQRYNGFLKAKFNFTVEGLWPHPHSPRVLVEKKGVIEQKFLAFTTAAPSWTQIGRLLVDKETRQGEGRRVATVVEQFREVYPRFRLALIVGGYRNNQASILERRHDVLVFNDGWQNGSDVINDIVEMGLGYKTALRKGLYTFVEGAKNHDVKGAGVAVHEVAERHYYRRSELLIPAILASIDYSQPNDVIARLRKELHQLCEALFNQVTAPYAHHPKLIRSLAVARASLHKHLNELKPQGELAYVDGD

SEQ ID NO: 81 - protein, 163 aa, Atlantibacter hermannii NBRC 105704
  misc_feature (1)..(163): Cse2
MSTEIDAMALYNAWQQLDNGSSAQLRRVSEPDELREIPAFYRLVQPFGWENPANKRPLLRMVFCLSAGKDVIHHKEKIDDYPSGISLGRALAKSGKINERRVFQLVRAQSPGDMIQLRRLLIHAEPVLDWSLFARQLTWWGKRERQQLLEDFMLATPESNKKA

SEQ ID NO: 82 - protein, 365 aa, Atlantibacter hermannii NBRC 105704
  misc_feature (1)..(365): Cas7
MNNFINFHVLISHSPSCLNRDDMNMQKDAVFGGKRRVRISSQSLKRAMRKSDYYARHIGASSLRTIHLEELRDVLRQKLSPRFELPIIDKTLSLLSGKTIDDAEKINGDAVTPWVLGEVEWFCEQVMKAEAEQLDDKKLLKMLKDDIAAMRTNLQQGVDVALSGRMATSGLMSELGKVDGAMSIAHAITTHTVDSDIDWFTAVDDLQDLGSAHLGTQEFSSGVFYRYASLNIAQLQENLGGVSREQVLEIAAHLAHMLATEVPGAKQHTFAAFNPADMVMINFSDFPLSLANAFESPIKAKDGYLLPSINAFNEYWQRIAKGYGLTGPAAQFMLAEASMAGGNVVSVETLEQLKKWICHDGEASR

SEQ ID NO: 83 - protein, 224 aa, Atlantibacter hermannii NBRC 105704
  misc_feature (1)..(224): Cas5
MKPYLILRLAGPMQAWGQPTFEGTRPTARFPTRSGLLGLLGACLGIQRDDRSALQALSESVRFAVRCDQSFIDGRTIPVTGLRDYHTVMDAREDYRGLKSHETIQTWREYLCDAVFTVAVWESEQATLRLPELKVAVCKPRFTPFLGRKSCPLTQPLFVDLCDAINPYQALANYAPAGGDIYSEAPPDGPCQTFTVRDEPIIALPRQFAAREWYVIKGASDVSQ

SEQ ID NO: 84 - protein, 199 aa, Atlantibacter hermannii NBRC 105704
  misc_feature (1)..(199): Cas6
MYLSKVIIQNAWCRDVYQFHQAIWQLFPSQPAQKRAFLFRIEAKHPGRGADVLLQSMEAPASSAAAQVLACKPLAFHLKEGDQLRFRLRANPIKTIKDEQQRLNGRGEIKRCRVPLLKEQEQHQWLIRKLSLAARLEHIESTSELPLFFSKNGTGGKIQPMNFEGILTVTSVPALLSLLNNGVGPAKAMGCGLLSLARP

SEQ ID NO: 85 - DNA, 90 bp, Atlantibacter hermannii NBRC 105704
  misc_feature (1)..(90): CRISPR
gtgttccccgcgccagcggggataaaccgttttaaaacaggatgtggcccgcctggtgctggtgttccccgcgccagcggggataaaccg

SEQ ID NO: 86 - DNA, 1512 bp, Geothermobacter sp. EPR-M
  misc_feature (1)..(1512): Cas8
atgaatctattgaccgatccgtggataccggcacggccccaaggcagggcgacagcgcagaagttgaccttgcgacagctgctgtgtgaagacgaacgctgggagttgcgtctgccacgtgatgacatggagatggcaacactgcaattgctgatctgcctgacccaggcgttggcaacgccggcagatttgccggagctgaaacgacgaattatgaagcctttgggacagcaggagttcaatgccgcctacactcctttcgcggactggttccggctcgatcatccgcagtatccgttcatgcaggtgcggggagtgaaggcgaaggagccgacgccgatggataaactgctggccgggttgacgggggcgaccaacagctgtttcgtcaaccaatcgggattgggcgaggggctttgcccggcttgcgctgctatcgctttgtttaaccaggcgatgaatgtccctggattcggtgggggattcaaagccagtttgcgcggcagtgctccggtcaccacactggtacaaggcgaacacctgcggcaaaccatctggttgaatgtgctgagcacggagtcggtcgaagctctgcttccctggcatcggcaaacggaagaccagaaaccgacctggatagctccaatcaaatccgaaaccttttcatcccgaagtatcgggtttctgcggggtctgttctggcagccggcgcacattgagttgctgcccgctgagtcggtcggagattgcagttgctgcggtcagggggacacggaagtgtatcgcggattcaataaggcgaaattcaattacaccgtgaccggcatttggccgcatcctcatggggcgagaacctctactgtgaaaaagggggaacaggaagagaagttcgtttctttcaccaccgaagctccctcctggactcagttgggtcgtttcgtggcacgccgtgcctttgttgacgccaaaactcccggtcaggaaccggcggcggtgatccgtcaggcgcaaaaacttggtgtgcggttgactctctgcatcggtggatatcgcaacaaccaagcctcgattctggagcgacggcatgagttgctaccccttggcgaggggtggaattcgaaaccccagattgttcaggatgttgtggatactgccatcggctatcgcgatgcgctgaacaagtcactgtattcctttttcaagggaggagggagcaagggcgccgggctgccgatccatgaattcggcaaggcccaattctaccgccgaacggaagaagccatcctcgacagcttggctcgtctcgatttcagtaatccacgtccggttctactcgcgcttcagaaaaaactggatacagaggtcaggggactgtttgaggaagcggtccgtccctatctgaacgaccccaacctgattcataccatggcggtttcccgccggactttatacaaaaatctcaacgtactgaaacctcaacaggagggaggagtcgatggcaaaagaaactga

SEQ ID NO: 87 - DNA, 480 bp, Geothermobacter sp. EPR-M
  misc_feature (1)..(480): Cse2
atggcaaaagaaactgattttatggatctgtatcaggcctggcagcgattgccgaacgggccaaaagccgagcttaagcgatgcggcgacttgggtgatctgcttgaaacctcggcgttttatcgtctgctcgccgggcggggtgaagcggaatggcagaagaaagcttatcagcgcatgatcttctgcctcccctgcatcaaccacacggaacagaaaatccctctgggcgctgcgctggcgagaagtcgcaaggggagccggtcggcggtttcagaaagccgtatgattcaagttgtgcgcagcgaagcgccgaacgacatggttcagttgcggcggattctcaagcacgccgaaccgacagtcaactggccgctgatggcaaaacagctttggtactgggatctcaacgaacgcagtaaacggagtttgctcgaagatttctttctcaatcacaccgacacatcaaaggagggttaa

SEQ ID NO: 88 - DNA, 1095 bp, Geothermobacter sp. EPR-M
  misc_feature (1)..(1095): Cas7
gtgcagaatttcatcaactatcacgttctcatttcgcacagtccgtcttgcctcaaccgcgacgacatgaatatgcagaagtcagccatcttcggtggtgtgcgccgagtacggatttcaagccagagtctgaaacgggcgatgcgtaaaagcgactattatgctcagcaccttggtgaagcgagtatccgcacaaagcatttgagtggactgcgggatcggttgcacgaaaggctggcggggcgtttttctcccgaagttatcgataaaactatcaagctgctcatcgacaaggacgtttccgtcgatggaatcgtcgaaggcgatgccgtggccccttgggcggtggaagagtttgcctggttctgcgagcgggttatgaatgcgcaggcggaagggctggaagacaaggctctgaccaagcagttgaaagaatctatcgccgcgatgcgacagacgctggttggcgggcttgatatcgcattatccgggcggatggccacctcggggttgctcagtgaacttggcaaggtcgatggtgcgctggccgtggcgcatgccttgaccacccacacggttgatgccgatatcgactggttcaccgctgtggatgatctgcaggaactgggatctgggcacctcgacacccaggaattctctagtggggtgttctatcgctacgccagtctgaacatcggccagttgcaggaaaacctcggtggcgcaccacgcgaacaggcgctggagattgccacgcacgtattgcagatgttggcgacggtagttccgtctgctaagcagcagagttttgccgcgcacaaccttgctgacttggcgttggtttccttcgccgatatcccggtatcgctggccaatgccttcgaaaaaccggtgcagcagaaaaacggcagtggattccgtgaaccttcgattgctgcgctgcacgactattggcagaaggtgcatatcggctacgggctggaagaacgctgcgggcagtttgttttgaacaaagtggaaacgcctgccgggatcgctgcgaaagagagccttgaggacctcaaaagttgggtgcgcaacaacggagaggggtga

SEQ ID NO: 89 - DNA, 678 bp, Geothermobacter sp. EPR-M
  misc_feature (1)..(678): Cas5
atgggcgactacctgattctgaaactgcaggggccgatgcaggcctggggggagcacagctttgaagggacgcgcccttcgggcaacttcccgacccgtagtgccctgctcggacttcttggtgcctgtctcggcattcgccggaatgaatacgaacgtttgcagcaattggcggacagcgttcaatttgccgtgcgtaaagatgctcgccagacgcaaaccgagtggggggagccgaaaaagctgccgatggtcaagatgactgattaccacaccgtcaaggacgcacggcagagttacattggcctcaaaagccacgaaaccattcagacctggcgggaatatctgcttgatgcggaatacagcgttgctatctgggaaaacgaggatgcagccgtgtcactggatgaattggaaacggccgtgcgcaaaccggtattcaccccttatcttgggcgacggagctgtccgttggcgcaaccgctgtttggcaaaaggcttaccgcggaaagtccgaaccaggccttgcaggctgttgaaccgagcggcggtgtgatttacagcgaacagccatcagatcgcagcatgcgcctgcgtgacctgccgatggcgggtcaaccacgccagttcgcttcccgcaccgtctacatccacggaggggatcatgtatctgagtaa

SEQ ID NO: 90 - DNA, 609 bp, Geothermobacter sp. EPR-M
  misc_feature (1)..(609): Cas6
atgtatctgagtaaggttatggtgactggggccgcctgtcgcaatccctatgaaatccaccgcagcctctggcaactgtttccagaagatcccgacgccaggcgagactacttgtttcgcgtagagcgcgccgggcggcagcaggctgaaatcttgttacagtcgcagcgaaaaccgagcgattcagagttgcgtaaggtccgactgctggcgacgcgagggtatcaaccgaggctgcagcaggggcaacggctgcgttttgcgttgctggccaacccggtcaagaccatcaacgatgaacgcggccgcctgaatgccaaaggccaggtgaaaaaatgccgggttccgctgattcgcgaggaggaatggcggagctggttggagcacaagctgattggttgtgcggagctggagacgctggtcgctgaaaatcgtctgccgataaatttccgcaagcccaaggaaaaacgtgtcgggaaaattcagccggtcagttttcaggggattttacgggtatctagcccggaagctatgatgcaggcaatctctaccggcatcggcccggctaaagccttcggttgcggcctgctgtcaatcgcccctgcgtga

SEQ ID NO: 91 - DNA, 1512 bp, Geothermobacter sp. EPR-M
  misc_feature (1)..(1512): Cas8
atgaacctgctgacagatccctggattcccgcaaggccacagggaagggcaaccgcacagaagctgacactgagacagctgctgtgcgaggacgagaggtgggagctgagactgcccagggacgatatggagatggccaccctgcagctgctgatctgtctgacccaggccctggcaacaccagcagatctgcccgagctgaagcggagaatcatgaagcccctgggccagcaggagtttaatgccgcctacaccccttttgccgattggttccgcctggaccacccccagtatcctttcatgcaggtgcggggagtgaaggcaaaggagccaacacccatggacaagctgctggcaggactgaccggagcaacaaacagctgttttgtgaatcagtccggcctgggagagggactgtgcccagcctgtgccgccatcgccctgttcaaccaggccatgaatgtgcctggctttggaggaggcttcaaggcctctctgaggggcagcgccccagtgaccacactggtgcagggagagcacctgaggcagaccatctggctgaacgtgctgtctacagagagcgtggaggccctgctgccatggcacaggcagaccgaggaccagaagcccacatggatcgcccctatcaagagcgagaccttcagctccagatccatcggctttctgaggggactgttctggcagccagcacacatcgagctgctgcctgcagagagcgtgggcgattgctcctgctgtggccagggcgacacagaggtgtacaggggctttaacaaggccaagttcaattataccgtgacaggaatctggcctcacccacacggagcacgcaccagcacagtgaagaagggcgagcaggaggagaagttcgtgagcttcaccacagaggcacctagctggacccagctgggccgctttgtggcaaggagggccttcgtggatgcaaagacacctggacaggagccagcagccgtgatcaggcaggcacagaagctgggcgtgcggctgaccctgtgcatcggaggctataggaacaatcaggccagcatcctggagcggagacacgagctgctgccactgggagagggatggaattccaagccccagatcgtgcaggatgtggtggacacagccatcggctaccgcgacgccctgaacaagtccctgtattctttctttaagggaggaggctccaagggagcaggactgcctatccacgagtttggcaaggcccagttctacaggcgcaccgaggaggccatcctggattccctggccagactggacttttctaatcccaggcctgtgctgctggccctgcagaagaagctggatacagaggtgagaggcctgttcgaggaggccgtgaggccatacctgaacgaccccaatctgatccacaccatggccgtgagccggagaacactgtataagaacctgaatgtgctgaagccacagcaggagggaggagtggacggcaagagaaactaa

SEQ ID NO: 92 - DNA, 480 bp, Geothermobacter sp. EPR-M
  misc_feature (1)..(480): Cse2
atggccaaggagacagatttcatggacctgtaccaggcctggcagagactgccaaacggaccaaaggcagagctgaagaggtgcggcgatctgggcgacctgctggagaccagcgccttttacagactgctggcaggaaggggagaggcagagtggcagaagaaggcctatcagcggatgatcttctgcctgccctgtatcaatcacacagagcagaagatccctctgggagccgccctggcacggagcagaaagggcagccggagcgccgtgagcgagtctaggatgatccaggtggtgcgctccgaggcaccaaacgatatggtgcagctgaggcgcatcctgaagcacgcagagccaaccgtgaactggcctctgatggccaagcagctgtggtactgggacctgaatgagaggagcaagcggagcctgctggaggatttctttctgaaccacaccgacacaagcaaggagggataa

SEQ ID NO: 93 - DNA, 1095 bp, Geothermobacter sp. EPR-M
  misc_feature (1)..(1095): Cas7
atgcagaactttatcaattaccacgtgctgatctctcacagcccatcctgcctgaaccgcgacgatatgaatatgcagaagagcgccatcttcggaggcgtgcggagagtgcggatcagctcccagagcctgaagcgggccatgagaaagtccgactactatgcccagcacctgggcgaggcctctatcagaaccaagcacctgagcggcctgagggataggctgcacgagcgcctggcaggccggttcagccccgaagtgatcgacaagacaatcaagctgctgatcgacaaggatgtgagcgtggatggaatcgtggagggcgacgcagtggcaccatgggcagtggaggagtttgcatggttctgtgagagagtgatgaacgcacaggcagagggcctggaggataaggccctgaccaagcagctgaaggagtccatcgccgccatgagacagacactggtgggcggcctggatatcgccctgtctggcaggatggccaccagcggcctgctgtccgagctgggcaaggtggacggcgccctggcagtggcacacgccctgaccacacacaccgtggacgccgatatcgactggtttacagccgtggacgatctgcaggagctgggctctggccacctggacacccaggagttttctagcggcgtgttctacagatatgccagcctgaacatcggacagctgcaggagaatctgggaggagcaccaagggagcaggccctggagatcgcaacccacgtgctgcagatgctggccacagtggtgccctccgccaagcagcagtctttcgccgcccacaatctggccgatctggccctggtgtcctttgccgacatccccgtgagcctggcaaacgccttcgagaagccagtgcagcagaagaatggctctggctttcgggagccaagcatcgccgccctgcacgactactggcagaaggtgcacatcggctatggcctggaggagagatgcggccagttcgtgctgaacaaggtggagacccctgcaggaatcgcagcaaaggagtccctggaggatctgaagtcttgggtgcgcaacaatggagagggataa

SEQ ID NO: 94 - DNA, 678 bp, Geothermobacter sp. EPR-M
  misc_feature (1)..(678): Cas5
atgggcgactatctgatcctgaagctgcagggacctatgcaggcctggggagagcacagctttgagggaacccgcccatccggcaatttccccacacggtctgccctgctgggactgctgggagcatgtctgggcatccggcggaacgagtacgagaggctgcagcagctggccgatagcgtgcagtttgccgtgagaaaggacgccaggcagacccagacagagtggggcgagccaaagaagctgcccatggtgaagatgaccgattaccacacagtgaaggacgccagacagtcttatatcggcctgaagagccacgagaccatccagacatggagggagtacctgctggacgccgagtattctgtggccatctgggagaatgaggatgcagccgtgagcctggacgagctggagaccgccgtgaggaagcccgtgttcaccccatacctgggcaggcgcagctgcccactggcacagcctctgttcggcaagcgcctgaccgcagagtccccaaaccaggccctgcaggcagtggagccttccggcggcgtgatctattctgagcagccctctgatcgcagcatgaggctgagggacctgcctatggcaggacagccaaggcagttcgcatctcggaccgtgtacatccacggaggcgatcacgtgtccgagtaa

SEQ ID NO: 95 - DNA, 609 bp, Geothermobacter sp. EPR-M
  misc_feature (1)..(609): Cas6
atgtacctgagcaaagtgatggtgaccggagcagcatgtaggaacccatatgagatccaccggtccctgtggcagctgttccccgaggaccccgacgcacggagagattatctgttccgggtggagagagcaggcaggcagcaggcagagatcctgctgcagagccagcggaagccaagcgactccgagctgcgcaaggtgcggctgctggcaaccagaggataccagccaaggctgcagcagggacagcggctgagatttgccctgctggccaaccctgtgaagacaatcaatgatgagaggggccgcctgaacgcaaagggacaggtgaagaagtgcagggtgccactgatcagggaggaggagtggagaagctggctggagcacaagctgatcggatgtgcagagctggagaccctggtggcagagaacaggctgcccatcaacttcagaaagccaaaggagaagagggtgggcaagatccagcccgtgagcttccagggcatcctgagagtgtcctctccagaggccatgatgcaggccatctctaccggcatcggaccagcaaaggccttcggctgcggactgctgagcatcgcaccagcataa

SEQ ID NO: 96 - protein, 503 aa, Geothermobacter sp. EPR-M
  misc_feature (1)..(503): Cas8
MNLLTDPWIPARPQGRATAQKLTLRQLLCEDERWELRLPRDDMEMATLQLLICLTQALATPADLPELKRRIMKPLGQQEFNAAYTPFADWFRLDHPQYPFMQVRGVKAKEPTPMDKLLAGLTGATNSCFVNQSGLGEGLCPACAAIALFNQAMNVPGFGGGFKASLRGSAPVTTLVQGEHLRQTIWLNVLSTESVEALLPWHRQTEDQKPTWIAPIKSETFSSRSIGFLRGLFWQPAHIELLPAESVGDCSCCGQGDTEVYRGFNKAKFNYTVTGIWPHPHGARTSTVKKGEQEEKFVSFTTEAPSWTQLGRFVARRAFVDAKTPGQEPAAVIRQAQKLGVRLTLCIGGYRNNQASILERRHELLPLGEGWNSKPQIVQDVVDTAIGYRDALNKSLYSFFKGGGSKGAGLPIHEFGKAQFYRRTEEAILDSLARLDFSNPRPVLLALQKKLDTEVRGLFEEAVRPYLNDPNLIHTMAVSRRTLYKNLNVLKPQQEGGVDGKRN

SEQ ID NO: 97 - protein, 159 aa, Geothermobacter sp. EPR-M
  misc_feature (1)..(159): Cse2
MAKETDFMDLYQAWQRLPNGPKAELKRCGDLGDLLETSAFYRLLAGRGEAEWQKKAYQRMIFCLPCINHTEQKIPLGAALARSRKGSRSAVSESRMIQVVRSEAPNDMVQLRRILKHAEPTVNWPLMAKQLWYWDLNERSKRSLLEDFFLNHTDTSKEG

SEQ ID NO: 98 - protein, 364 aa, Geothermobacter sp. EPR-M
  misc_feature (1)..(364): Cas7
MQNFINYHVLISHSPSCLNRDDMNMQKSAIFGGVRRVRISSQSLKRAMRKSDYYAQHLGEASIRTKHLSGLRDRLHERLAGRFSPEVIDKTIKLLIDKDVSVDGIVEGDAVAPWAVEEFAWFCERVMNAQAEGLEDKALTKQLKESIAAMRQTLVGGLDIALSGRMATSGLLSELGKVDGALAVAHALTTHTVDADIDWFTAVDDLQELGSGHLDTQEFSSGVFYRYASLNIGQLQENLGGAPREQALEIATHVLQMLATVVPSAKQQSFAAHNLADLALVSFADIPVSLANAFEKPVQQKNGSGFREPSIAALHDYWQKVHIGYGLEERCGQFVLNKVETPAGIAAKESLEDLKSWVRNNGEG

SEQ ID NO: 99 - protein, 225 aa, Geothermobacter sp. EPR-M
  misc_feature (1)..(225): Cas5
MGDYLILKLQGPMQAWGEHSFEGTRPSGNFPTRSALLGLLGACLGIRRNEYERLQQLADSVQFAVRKDARQTQTEWGEPKKLPMVKMTDYHTVKDARQSYIGLKSHETIQTWREYLLDAEYSVAIWENEDAAVSLDELETAVRKPVFTPYLGRRSCPLAQPLFGKRLTAESPNQALQAVEPSGGVIYSEQPSDRSMRLRDLPMAGQPRQFASRTVYIHGGDHVSE

SEQ ID NO: 100 - protein, 202 aa, Geothermobacter sp. EPR-M
  misc_feature (1)..(202): Cas6
MYLSKVMVTGAACRNPYEIHRSLWQLFPEDPDARRDYLFRVERAGRQQAEILLQSQRKPSDSELRKVRLLATRGYQPRLQQGQRLRFALLANPVKTINDERGRLNAKGQVKKCRVPLIREEEWRSWLEHKLIGCAELETLVAENRLPINFRKPKEKRVGKIQPVSFQGILRVSSPEAMMQAISTGIGPAKAFGCGLLSIAPA

SEQ ID NO: 101 - DNA, 90 bp, Geothermobacter sp. EPR-M
  misc_feature (1)..(90): CRISPR
ctgttccccgcacccgcggggatgaaccggtcatctatttttaatggacgatatttttcaactgttccccgcacccgcggggatgaaccg

SEQ ID NO: 102 - DNA, 1509 bp, Methylocaldum sp. 14B
  misc_feature (1)..(1509): Cas8
atgaatctgcttgaagacccttggattcccgtgcgtgccgatggcggtacgggcgctttccaactgctgacctatcggcagctactttgcgaacccggcaactggcaggtgagcttgccgcgtgacgatctggagctggcctgtgtgcaattgctggtgtgcatgactcaggtgatgttcttgccggaaaacgacgctgtttggcggaagcggttgactgaagctttgacgcgtgaagagttcaccgccggcacagaaccgtgcctggattggttcgatctcgaccacccgacccagcctttcatgcaatcacgaggagtgagggccgccgaggacacgcccattcagaagctgctgattggcctgccggaaggaaacaaccacgctttcttcaacgaggcgggcgaagtgcgccacctatcggtaacagtggcagcaattgccctgttcaatcaggctactaattgccccagtttcggcggcggcttcaagggcagcctacgtggaggcgcgccaatcaccacactggtgaatggcgagaatttgcgcgaaaccgtctggtgtaatgtactcacacgctcccgtttggctgcgcgccagatcgccatgcccggattggatcgggaccgtccaacctgggtcgagcctatccaggaaaaagccaccattccctggaacaccatcggtttggcgcgaggcttgttttggcagccggcgcgggtggaactggtgaggtccatggccgctgcaccttgcgatgtgatgggcggcgcgcccacattgggatacgtgggatttcgcaaggagaaattcaactttaccgtggagggagtgtggccccaccctcatggcgcaataaccatgaccttgaaaaaaggcgcgcttgaacaaaagttcgccagcttcacgaccaccgcgccggcatggacccagctctccgaattcgtcgtgcccaaaggcgtcaatgatcccggagccaaagagggctccattcccgcaggaccggttacacaagccagcgagctaggcgaaagcggtttacacctgctcgttggcggctatcgcaccaatcaagcttccgtgttggaacggcgccacgaaatgatgagcctggcccgaggctggcgggatgacaaaagccgcctgcccaaattggtcgaaatgggcaaagaggcaaaaaaagccttgcgcggcaagctctatttcgccgttcagggcaataaagacaaagggcttaaaggtattggcgcggccatccacgaaaccgccgagaaactgttttacgcccgaaccgaaagtctgatccacgaaaccttttccaatgaactcacgttcaagcagtgggccaccgcccgcaaggcttttgtccaggaattggccggccattgccgcgcaatttttgaggagctgactgcaccttatgcgatgaaaccggagttgattccggttatcgcctgggcgcggcgcagcctgaatttcgatcttaccaagctgatggaggatgcatga

SEQ ID NO: 103 - DNA, 456 bp, Methylocaldum sp. 14B
  misc_feature (1)..(456): Cse2
atgactgccgaattgccggattttgtcgcgctgaaaatgcactacgacgacgagagctttccgaccggcgcacgtgccgagctgcgccgtgctgccgaaccggatgatgtggcgttgaccccggcgctctaccgcttattccccggcgagcggccgagcgaccgccacttacgtgtcgcctatctcctgccctatgccaaacacgcggctaaagccaagtcgttgggtgcgcaactggcggaagccaaggtggcggaagcacgggttctgcaagtggcccgcgctcatgaaccgctcgatgtggtccagttacgtcgcctcttgatgcaggttgaagccgcagtggactggtcggcgttcggcccgatggtgtggttttggaacgaacgagccaaacgtcagctcatcgaggatttctatatcgcccgtttttcccccgtcacaggagctaaataa

SEQ ID NO: 104 - DNA, 1137 bp, Methylocaldum sp. 14B
  misc_feature (1)..(1137): Cas7
atgaccaagaagaacttcatcaacttccatgtactcatttcccacagcccctcctgtctcaaccgggacgatatgaacatgcagaaaaccgccgtatttggtggcgtcaaccgggtgcggatttccagccaatctctgaagcgggcgatacgcaagagcgattactaccaagccaatttgggcgcaccatcggtgcgcacccgcgatttgaacaaactcaaagcgcgtttcaccgaactgctcaaagaccgctttgacgccgaattgattaaccgcgcgctggagtggatttccggcaaggaaggtatcgccgaaggcgtaacggccgacgccgttgcgccctggtcggtggatgaagtaacgcacttctgcgaaatcattagcgccgacgaccagcaagatatcaagaaactggaaaagcagattgaaaaagaggcgcgtcctttccgggcggctatgagcaacaccgtggacatcgccttgtccggtcgtatggcgaccagtggattgatgagcaacctgcccgtggatggcgcgctcgccgtcgctcacgccattaccacccatgccgtcgagccgcaggacgtggactggttcaccgccgtcgacgatttgacccaggacgcgggcgatacgggagcgggacatctggatacccagcagttttcctccggcgtgttctaccgttacgccagtctcaacctgagacaactgcaagtgaacctgggattgatcgaccacatcaaggcggaggaaaccgccgagtcccgccaacgtgcgctggacatcgcccatcatgtattccatttactggcgacggtggtgccttcggccaagcaacagtctttcgccgctcacaacttggcggacttcgccatcgtcagcttcgccgaccagccgatttcgttagccaatgcattcgaagaaccggtcagacgcgattacaaactggcgggattcctcaaaccatccattcagtgtttggccaattactggggacgcatgaatcgcgcctacggtctggacgaacaggcgcgcgctttcgcggtcgatgcgagcttcgagatgggcggcaagcctcccctggactccctgaaagcggtggaagactggatcgccgaggatggtcaggaataa

SEQ ID NO: 105 - DNA, 681 bp, Methylocaldum sp. 14B
  misc_feature (1)..(681): Cas5
atgccgcgttatttgattctcctcctggacggtcccatgcaagcgtggggcacgcacacgttcgaagattttcgcccttgcaatgcgtttccgactcgcagcggtttgctcggactgctaggtgcctgcctggggttggaccggcgcgataccgaagcattggagcaattggcgatgagcgtcgagttcgccgtacgcgccgacagagaggtgttgcggccggaagcggaagtacccaaggcaaaagccgctgtaaagcttcccgacttccacacggtggaggatgctcgcaaggtagacggttccgccaacaagaacccggtggtttctcggcgcgaatacctgttcgatgccgctttcaccgtggcgatcggcgcaaagcccgacgggccggttacgctggatgcaattgccgaagctttgcggcgcccgtgttttacgcctgtgctgggacggcgttcctgtcccatcgcccggcctttgctcgatggcgaggccgtggaggcgagcgatgcgaaggcggcactggcaaccatcgcacctgtaggtggcatgatctataccgaaggcgaattgatctccgcacaacccttgcgggtccgcgacgtacccatacagggccggcaccggcaattcagcactcgactggtgtatctccataagggggaaacatgttcctga

SEQ ID NO: 106 - DNA, 627 bp, Methylocaldum sp. 14B
  misc_feature (1)..(627): Cas6
atgttcctgagccgtgtcgagattccttgggatgcagtccgcaacccttacgaaattcatcgccagctttggcggctgtttcccggagaggacaaagaaccccggaagaatgccgaggaaggacgccaagggttcctgttcagggtggaaaacaatcagcctggccgcccgctgcgtttgttgattcagtctcggcgagcgccagagcctacggctggattgacgattgtaggtacgcgcgaattccaaccccagccagctcacgggcagcgcttggcatttctactcacctcaaatccggtcaaaaccattatcgatgcacagcgagaaaccaagtcgggcaaaagctccgaaaagtgccgtgtgccgttgattcacgaatccgaacagcgcgaatggttaaagcgcaaactcatcggtgcgggagaatttgaaggtgtcaatgtggtgcctcacgccccggtgttctttcggaaaggcaatcggggcggcaagatagtcatggtgactttcgaaggcgtattgcgtgtaaacgagccaggaacgttgatcgcctatttggaaaacggcatcggccccgccaaagccttcggttgcggtttgctgttagtacggcgcttgggataa

SEQ ID NO: 107 - DNA, 1509 bp, Methylocaldum sp. 14B
  misc_feature (1)..(1509): Cas8
atgaatctgctggaggacccttggattcccgtgcgggcagatggaggaaccggagcattccagctgctgacatacaggcagctgctgtgcgagccaggaaactggcaggtgagcctgccaagggacgatctggagctggcctgcgtgcagctgctggtgtgcatgacccaggtcatgtttctgcctgagaatgacgccgtgtggaggaagcgcctgaccgaggccctgacaagagaggagttcacagccggcaccgagccatgtctggactggtttgacctggatcaccccacccagcctttcatgcagtctaggggcgtgcgcgcagcagaggatacaccaatccagaagctgctgatcggcctgcctgagggcaacaatcacgccttctttaatgaggcaggagaggtgcggcacctgagcgtgaccgtggccgccatcgccctgttcaaccaggccacaaattgcccttcctttggcggaggcttcaagggctctctgaggggaggagcaccaatcaccacactggtcaacggcgagaatctgcgggagaccgtgtggtgtaacgtgctgacacggtccagactggcagcaaggcagatcgcaatgccaggcctggacagggataggcctacctgggtggagccaatccaggagaaggccaccatcccctggaatacaatcggactggcaaggggactgttttggcagcctgcccgggtggagctggtgagaagcatggcagcagcaccttgcgacgtgatgggaggagcaccaaccctgggatatgtgggcttcagaaaggagaagtttaacttcacagtggagggcgtgtggccacacccacacggagccatcacaatgaccctgaagaagggcgccctggagcagaagtttgccagcttcaccacaaccgcacctgcatggacccagctgtccgagttcgtggtgccaaagggagtgaacgatccaggagcaaaggagggctccatcccagcaggaccagtgacccaggcctccgagctgggagagtctggcctgcacctgctggtgggaggatacaggacaaatcaggccagcgtgctggagcggagacacgagatgatgtccctggcccggggctggagagacgataagagccggctgccaaagctggtggagatgggcaaggaggccaagaaggccctgaggggcaagctgtattttgccgtgcagggcaacaaggacaagggcctgaagggaatcggagcagcaatccacgagaccgccgagaagctgttctacgccagaacagagtctctgatccacgagaccttcagcaatgagctgaccttcaagcagtgggccacagccagaaaggcctttgtgcaggagctggcaggacactgtagggcaatcttcgaggagctgaccgccccctacgccatgaagcctgagctgatcccagtgatcgcatgggcaaggcgcagcctgaacttcgacctgacaaagctgatggaggatgcctaa

SEQ ID NO: 108 - DNA, 456 bp, Methylocaldum sp. 14B
  misc_feature (1)..(456): Cse2
atgacagcagagctgccagattttgtggccctgaagatgcactatgacgatgagtccttccccaccggagcaagggcagagctgaggcgcgcagccgagcctgacgatgtggccctgacaccagccctgtacaggctgtttcctggagagaggccatctgacaggcacctgcgcgtggcatacctgctgccctatgccaagcacgccgccaaggccaagagcctgggagcacagctggcagaggcaaaggtggccgaggcccgggtgctgcaggtggccagagcacacgagcccctggacgtggtgcagctgcggagactgctgatgcaggtggaggcagcagtggattggtccgcctttggccctatggtgtggttctggaacgagcgggccaagagacagctgatcgaggacttttatatcgcccgcttctctccagtgaccggagcaaagtaa

SEQ ID NO: 109 - DNA, 1137 bp, Methylocaldum sp. 14B
  misc_feature (1)..(1137): Cas7
atgaccaagaagaactttatcaatttccacgtgctgatcagccactccccttcttgcctgaacagagacgatatgaatatgcagaagacagccgtgttcggcggcgtgaatcgggtgagaatcagctcccagtccctgaagcgggccatcagaaagtctgactactatcaggccaacctgggagcaccaagcgtgaggacccgcgatctgaataagctgaaggcccggtttacagagctgctgaaggacagattcgatgccgagctgatcaacagggccctggagtggatctccggcaaggagggcatcgcagagggagtgaccgcagacgcagtggccccatggtctgtggatgaggtgacacacttttgtgagatcatcagcgccgacgatcagcaggacatcaagaagctggagaagcagatcgagaaggaggcaaggcccttccgcgcagcaatgagcaacaccgtggacatcgccctgtccggcaggatggccacatctggcctgatgagcaatctgccagtggatggcgccctggcagtggcacacgcaatcaccacacacgccgtggagcctcaggacgtggattggttcaccgccgtggacgatctgacacaggacgcaggcgataccggagcaggacacctggatacccagcagttttctagcggcgtgttctacagatatgcctccctgaacctgcgccagctgcaagtgaatctgggcctgatcgaccacatcaaggcagaggagaccgcagagtctcggcagagagccctggatatcgcccaccacgtgtttcacctgctggccacagtggtgccttccgccaagcagcagtctttcgccgcccacaacctggccgactttgccatcgtgagcttcgccgatcagccaatctccctggccaatgcctttgaggagcccgtgcggagagactacaagctggccggcttcctgaagccatccatccagtgcctggccaactactggggccggatgaatagagcatatggcctggacgagcaggcaagggcctttgccgtggatgccagcttcgagatgggcggcaagccccctctggattccctgaaggccgtggaggactggatcgccgaggatggacaggagtaa

SEQ ID NO: 110 - DNA, 681 bp, Methylocaldum sp. 14B
  misc_feature (1)..(681): Cas5
atgcctcggtacctgatcctgctgctggacggaccaatgcaggcctggggaacacacacctttgaggatttcagaccctgcaacgccttccctaccaggagcggcctgctgggactgctgggagcctgtctgggcctggacaggcgcgatacagaggccctggagcagctggccatgtccgtggagtttgccgtgagggcagacagggaggtgctgaggccagaggcagaggtgccaaaggcaaaggcagcagtgaagctgccagatttccacaccgtggaggacgcccgcaaggtggatggctctgccaacaagaatcccgtggtgagccggagagagtatctgtttgacgcagccttcaccgtggcaatcggagcaaagcctgacggaccagtgacactggatgcaatcgcagaggccctgaggcgcccctgctttacccctgtgctgggccggagatcttgtccaatcgccagaccactgctggacggagaggcagtggaggccagcgatgccaaggccgccctggcaaccatcgcaccagtgggcggcatgatctatacagagggagagctgatctccgcccagccactgagggtgcgcgacgtgcctatccagggccggcacagacagttctctacccgcctggtgtacctgcacaagggcgagacatgcagctaa

SEQ ID NO: 111 - DNA, 627 bp, Methylocaldum sp. 14B
  misc_feature (1)..(627): Cas6
atgtttctgtcccgcgtggagatcccatgggacgccgtgcggaacccctacgagatccacaggcagctgtggaggctgttcccaggagaggataaggagcctcgcaagaatgccgaggagggcaggcagggcttcctgtttcgcgtggagaacaatcagcccggccggcctctgagactgctgatccagagcaggagggcccctgagccaacagcaggactgaccatcgtgggcacaagagagtttcagccacagcctgcacacggacagaggctggccttcctgctgacatctaaccctgtgaagaccatcatcgacgcccagcgcgagaccaagagcggcaagtcctctgagaagtgccgggtgccactgatccacgagtccgagcagagggagtggctgaagaggaagctgatcggagcaggagagttcgagggagtgaacgtggtgccacacgcacccgtgttctttcggaagggcaatagaggcggcaagatcgtgatggtgacctttgagggcgtgctgagggtgaacgagccaggcacactgatcgcctatctggagaatggcatcggaccagcaaaggccttcggctgcggactgctgctggtgcggagactgggataa

SEQ ID NO: 112 - protein, 502 aa, Methylocaldum sp. 14B
  misc_feature (1)..(502): Cas8
MNLLEDPWIPVRADGGTGAFQLLTYRQLLCEPGNWQVSLPRDDLELACVQLLVCMTQVMFLPENDAVWRKRLTEALTREEFTAGTEPCLDWFDLDHPTQPFMQSRGVRAAEDTPIQKLLIGLPEGNNHAFFNEAGEVRHLSVTVAAIALFNQATNCPSFGGGFKGSLRGGAPITTLVNGENLRETVWCNVLTRSRLAARQIAMPGLDRDRPTWVEPIQEKATIPWNTIGLARGLFWQPARVELVRSMAAAPCDVMGGAPTLGYVGFRKEKFNFTVEGVWPHPHGAITMTLKKGALEQKFASFTTTAPAWTQLSEFVVPKGVNDPGAKEGSIPAGPVTQASELGESGLHLLVGGYRTNQASVLERRHEMMSLARGWRDDKSRLPKLVEMGKEAKKALRGKLYFAVQGNKDKGLKGIGAAIHETAEKLFYARTESLIHETFSNELTFKQWATARKAFVQELAGHCRAIFEELTAPYAMKPELIPVIAWARRSLNFDLTKLMEDA

SEQ ID NO: 113 - protein, 151 aa, Methylocaldum sp. 14B
  misc_feature (1)..(151): Cse2
MTAELPDFVALKMHYDDESFPTGARAELRRAAEPDDVALTPALYRLFPGERPSDRHLRVAYLLPYAKHAAKAKSLGAQLAEAKVAEARVLQVARAHEPLDVVQLRRLLMQVEAAVDWSAFGPMVWFWNERAKRQLIEDFYIARFSPVTGAK

SEQ ID NO: 114 - protein, 378 aa, Methylocaldum sp. 14B
  misc_feature (1)..(378): Cas7
MTKKNFINFHVLISHSPSCLNRDDMNMQKTAVFGGVNRVRISSQSLKRAIRKSDYYQANLGAPSVRTRDLNKLKARFTELLKDRFDAELINRALEWISGKEGIAEGVTADAVAPWSVDEVTHFCEIISADDQQDIKKLEKQIEKEARPFRAAMSNTVDIALSGRMATSGLMSNLPVDGALAVAHAITTHAVEPQDVDWFTAVDDLTQDAGDTGAGHLDTQQFSSGVFYRYASLNLRQLQVNLGLIDHIKAEETAESRQRALDIAHHVFHLLATVVPSAKQQSFAAHNLADFAIVSFADQPISLANAFEEPVRRDYKLAGFLKPSIQCLANYWGRMNRAYGLDEQARAFAVDASFEMGGKPPLDSLKAVEDWIAEDGQE

SEQ ID NO: 115 - protein, 226 aa, Methylocaldum sp. 14B
  misc_feature (1)..(226): Cas5
MPRYLILLLDGPMQAWGTHTFEDFRPCNAFPTRSGLLGLLGACLGLDRRDTEALEQLAMSVEFAVRADREVLRPEAEVPKAKAAVKLPDFHTVEDARKVDGSANKNPVVSRREYLFDAAFTVAIGAKPDGPVTLDAIAEALRRPCFTPVLGRRSCPIARPLLDGEAVEASDAKAALATIAPVGGMIYTEGELISAQPLRVRDVPIQGRHRQFSTRLVYLHKGETCS

SEQ ID NO: 116 - protein, 208 aa, Methylocaldum sp. 14B
  misc_feature (1)..(208): Cas6
MFLSRVEIPWDAVRNPYEIHRQLWRLFPGEDKEPRKNAEEGRQGFLFRVENNQPGRPLRLLIQSRRAPEPTAGLTIVGTREFQPQPAHGQRLAFLLTSNPVKTIIDAQRETKSGKSSEKCRVPLIHESEQREWLKRKLIGAGEFEGVNVVPHAPVFFRKGNRGGKIVMVTFEGVLRVNEPGTLIAYLENGIGPAKAFGCGLLLVRRLG

SEQ ID NO: 117 - DNA, 90 bp, Methylocaldum sp. 14B
  misc_feature (1)..(90): CRISPR
ctgttccccacgtacgtggggatgaaccgacggcgtaatggtaattgttagccgacaagttctgttccccacgtacgtggggatgaaccg

SEQ ID NO: 118 - DNA, 1632 bp, Methanocella arvoryzae MRE50
  misc_feature (1)..(1632): Cas8
ttgaaaaatcgagtgaaaagaggtgaacatttggtctcatataacttgttaacagaaccgtggatcacatccatcgacctgtccggaaacccggtgcaggagggaatactggcgactttgaaaaacgcacataagatcgacagtatttttgatccggctcctccggtagaattcggaatataccgcctgctgatcgcttttataacagatgtcttccagcctcagggactggaggatctggccgatctcctcgaccgtaagcggttagaccccacagcgctggacgaatatgccgccaggtggagagaccggtttgatctgttcgacgaaaaatacccgttcttacagcaggcaataacgggggtaataaagaaacctcccgagccgatctccaggttgatgcagcatctgccggcaggcactaacgtctcccattttcaccatggacgctgggatgagaactccttctctttcgagcagtgcgccaaagggctggtgactatagccccgttcatgacagccggcggcgctggcctgtccccaagcattaacggcagcccaccttggtacgttcttgtaaaaggcaacaacctgttcgagactctcctctacaacgtctgccagataccaatgactgtcaaacctatcggagattcacctgtagcctggaggaacgacaaacgaatcgatcccggcgatgaacctaaaaccttttccatcgtcgaaggtctgacctggaggcccaggatcattcagcttatcccgggaaacggcaagggcacatgcacgtatactggagaaaaagacgttgacacggtcagccacatgcattattacccgggacaaaaatcgcccgagccaggcctgtgggtcgatcctcaggtagcatataaaaagactaaggatgccatcaggccgctcaggccggacgagaacaaggcgctgtggcgagacattgggccgttgatgctcctgcaacacggggactactcgggcaaagacggaaaagtaagcttcgatcggccggcggtagttactcagtacaaacagatggtcagcaatggtatgatcaaacgcagcgagcctttaagactggaagtttatggtatccgcacagatggaaaaatgaagatttacgaatggtaccatgaaaaactagctcttcccatagaaatcttgaaaaaggcaaactccggccgacaaatacaggacgcgatggacctcgcagatagcgtagcttacatactccggaaagccatgaaaaaagcctacccgagaaatgcaaaatctaacgagagtggattcgacaatctcattctgagcgttcagtcttcctactggagccatctgaaaggccagttcgaaagcattttcttaaaaacgctgtctcaacaggacgaaaatgatctcgacgcatacactaagctcatggaacagtggaagaaaatactggacgatactggaaagaacgcgctcgataaaggcctcggaccgctggatactgacggcgattcgctacgccgccaggtcaaggcgatgaacgagtacagttcaggcatcagatttgcgctgtaccctgattccatacaggcgaagaaaaagaatcgacagaaaaataaggaggataaatga

SEQ ID NO: 119 - DNA, 591 bp, Methanocella arvoryzae MRE50
  misc_feature (1)..(591): Cse2
atgaccgctcccaacgaaaacaaagagcaccagaagagtaaaaaggatgaggagttcctggcgaacttagcaaagatggccgaatccgatcgtggcggtatggccatcctgaagcgaaacgccggcaacacgatagcagagtctcgcggcgcgatgaaaactttctatagcctgctaccttacggcatttcagattccccctacgaggagatctacttcctgatagccactctgtacgggcataataagtaccgatttacaggggacttcggacagacgatgaagcttgtaagagagagctcaaactcggaaagcatcgaccagagagtgtcaactctgctcgacagcgagttcaacatcgtcgacgggataaaacccggcgggggagaactcgcctatcggctgcggcaatgcgtgaaactggccagcggccacgagatcggggtagactggtacaggctcctgcaggacctgaaatactggggctacccggaaaagagagtacagaagagatgggccagatcatatttcggctacggaaagccggtagaatctgaaactaaagagtcaaaagaggaggcaaaagcatga

SEQ ID NO: 120 - DNA, 1176 bp, Methanocella arvoryzae MRE50
  misc_feature (1)..(1176): Cas7
atgaaattaatcgagatacacatgatccagaaccacgctccctgcaatctgaacagggatgacacaggaagcccgaaagactgcatgttcggcggcatcaggcgatcgaggatatccagccagagcatcaagcgcagcatcaggatgtccccgatattcaaggaagagatgaagggaatcgaactggcgaacaggacacgcaggcttcctgaactcgtcaaggccaagctcatcagtgatggaatagacgaaaagatggcggccatagcggcagaaaaggccaccggtttcggaaccaaggacggtaaagaacgcgaggaagacctgaacacggcccagacaatgttcataacccagtctgacgtcgacgctgtagcatcggtcatgaaggatgccatcctgaaagccggaaaccctaaggcattcaaggacatgaaagccgccgatcttcaaaaagccgcagaactcaagggatggcggcctgtaacaccggacctggcccttttcggccggatgatcacatcggatgcattcatggacatcgaggcatccatgcaggtggcccatgcgatctccacgaacaaaatggaccacgagtttgattacttcactgccgtggatgaccttcagaagtcttccgacggccccggagcagatatgatcggcgacgtccagttcaactctgcctgctactacaagtacttctcactggattacgatgccctgatacagaatctcgcaggcttgaaacccggagataatgccacggaagccgataaaaaagcctatgctgaatcgctggaaaacgcgaaaaaagtcgccgcgatcactatcaccgcctttctaaaagcggccatctacacgacgcccagtggaaagcagaacagcttcgccgcgcatcagctccccagcgccgtccttgtggaaattcggccaacaaagacgccagtaagctacgctaacgcgttcgttgatccggcccgcccgagaaacggtgtcgacatggtggaagataccctgaacaaattcgtgaaacatgtcgagctccagactgagaagttcaacctgagatcgaccaggcggctctggttcgttgcgggcgataaggcgctcgccggaacggaaacctgccagacgatcaacgatctaatatccggtataaacagtgccctctaa

SEQ ID NO: 121 - DNA, 684 bp, Methanocella arvoryzae MRE50
  misc_feature (1)..(684): Cas5
atggacaacccattgctcctgctgttgaggctggaggggccaatgcagtcatgggggctgaaagccaggtgggatatcagagataccggggacgagcctaccaagtccggcatcatcggactgctcggctgcgctctcggatatgcccgaaaggacccgcggctgactgacgaactggactcacaacttcggataggcattcgtgtggagtgccccggcgaaatcgccagggattaccacacggtcagcggagagcttcggaccgccgaaggtaagctccgcgaaacgacgattgtatccttcagagactatctccaggatgcagcgttcctcgtagtactcgaaggcccgggagaactgcttaccagaataagcaacgctctgaaagaccctgtatggccaatctatctgggaagaaaatcctgcccaccgacccgccccgtcttcgaaaccctgaccactgactatgcttcgatagacgatgcactgagccgacacccgtggagttccgggactatggaagcccgcaaagcgcaccccaaagaattaaaatgtatagtcgaagacctctccggaccttaccagaggactgatcggatgacgaaaagcccggccagaatgtacggcatcaggcacgtccggatgagcactgtaaaacttcaagcagaaggagagggcctttaa

SEQ ID NO: 122 - DNA, 753 bp, Methanocella arvoryzae MRE50
  misc_feature (1)..(753): Cas6
atgtatttatcaagactgatcctgaacccgagaacaagggctgtcagaagagacctcgctgactgccacgaacttcatcggactattctggggggctttccggaccttaatggaaaaggaggcgaagcaagggaaaccttcggcgttctccaccggatcgacatccaccccagaagcggcgcgatcgtactactggtccagtcgcaggaaaagcccgactggtcaaagctgccagaaggctatctactcgaaaatacgggcacggaaaatccagcctgtaaggctatagacgaacagtacgggaaaataaaggccggcgatgtctatgctttccgtcttcgagccaatcctacgaaaaagatcggcacgtcccggattgaggacatcaaagccggcaagcctaaaaataacgggcggcgggtgccgatcagaaacgagagcgaccagatcctctggctgaaaagaaaaggcgcggcaggaggcttcgaactcatgtccacgaagaggtttagcgaactctccgatgtgctcatcagtgaagaaggccatcagaaaatatacaccttcgacactggaataaaagcaaaagtccagaaaaacgcccgggaaaatagattaaccttcggctcggtccttttcgaaggcaccctgaaagtgacaaatgcagaaaagttcctcgaaaccctcaaatccggcatcggcagcggcaaagcctatggcttcggcctcctatccttagctccggcaaggtga

SEQ ID NO: 123 - DNA, 1632 bp, Methanocella arvoryzae MRE50
  misc_feature (1)..(1632): Cas8
atgaagaatcgcgtgaagcggggcgagcacctggtgtcttataacctgctgacagagccttggatcacctctatcgatctgagcggcaatccagtgcaggagggcatcctggccaccctgaagaacgcccacaagatcgatagcatctttgaccctgcccctccagtggagttcggcatctacaggctgctgatcgcctttatcaccgacgtgttccagccacagggcctggaggacctggcagatctgctggacaggaagcggctggaccccacagccctggacgagtacgcagcacggtggagagataggtttgacctgttcgatgagaagtatccattcctgcagcaggccatcaccggcgtgatcaagaagccccctgagcccatctctcgcctgatgcagcacctgcctgccggcacaaatgtgagccactttcaccacggccggtgggacgagaactcttttagcttcgagcagtgcgccaagggcctggtgacaatcgcacccttcatgaccgcaggaggagcaggcctgtccccttctatcaacggcagcccaccctggtacgtgctggtgaagggcaacaatctgtttgagacactgctgtataacgtgtgccagatccccatgaccgtgaagcctatcggcgatagcccagtggcctggagaaacgacaagaggatcgaccctggcgatgagccaaagacattctccatcgtggagggactgacctggaggcctcggatcatccagctgatcccaggcaatggcaagggcacctgtacatataccggcgagaaggacgtggataccgtgtcccacatgcactactatccaggccagaagtctcctgagccaggactgtgggtggacccccaggtggcatacaagaagacaaaggatgccatcagacccctgaggcctgacgagaataaggccctgtggcgcgatatcggaccactgatgctgctgcagcacggcgattactctggcaaggacggcaaggtgagcttcgatcggccagccgtggtgacccagtataagcagatggtgtccaacggcatgatcaagcggagcgagccactgcggctggaggtgtacggcatccgcacagacggcaagatgaagatctacgagtggtatcacgagaagctggccctgcccatcgagatcctgaagaaggccaattccggccggcagatccaggacgccatggatctggccgactctgtggcctacatcctgagaaaggccatgaagaaggcctatcctaggaacgccaagtccaatgagtctggctttgacaacctgatcctgagcgtgcagtctagctattggtcccacctgaagggccagtttgagtctatcttcctgaagacactgagccagcaggatgagaatgacctggatgcctacaccaagctgatggagcagtggaagaagatcctggacgatacaggcaagaacgccctggacaagggactgggacccctggacaccgatggcgactccctgcggagacaggtgaaggccatgaacgagtactcctctggcatcagattcgccctgtatcctgactctatccaggccaagaagaagaacaggcagaagaataaggaggataagtaa

SEQ ID NO: 124 - DNA, 591 bp, Methanocella arvoryzae MRE50
  misc_feature (1)..(591): Cse2
atgacagccccaaacgagaataaggagcaccagaagagcaagaaggacgaggagttcctggccaacctggcaaagatggcagagagcgataggggaggaatggccatcctgaagcggaacgccggcaatacaatcgccgagagccggggcgccatgaagaccttttacagcctgctgccatatggcatcagcgactccccctacgaggagatctatttcctgatcgccaccctgtacggccacaacaagtataggtttacaggcgacttcggccagaccatgaagctggtgcgcgagtcctctaattctgagagcatcgatcagcgggtgagcacactgctggattccgagtttaacatcgtggacggcatcaagccaggaggaggagagctggcatacaggctgaggcagtgcgtgaagctggcaagcggccacgagatcggagtggattggtatagactgctgcaggacctgaagtactggggctatccagagaagagggtgcagaagcggtgggcccggtcctacttcggctatggcaagcccgtggagtctgagaccaaggagagcaaggaggaggcaaaggcataa

SEQ ID NO: 125 - DNA, 1176 bp, Methanocella arvoryzae MRE50
  misc_feature (1)..(1176): Cas7
atgaagctgatcgagatccacatgatccagaaccacgccccctgcaacctgaatagagacgataccggcagccctaaggactgtatgtttggaggcatccggcggagccggatcagctcccagagcatcaagagatccatcaggatgtctcctatcttcaaggaggagatgaagggcatcgagctggccaatcgcacaaggcgcctgccagagctggtgaaggccaagctgatctccgatggcatcgacgagaagatggcagcaatcgcagcagagaaggcaacaggctttggcaccaaggatggcaaggagcgggaggaggacctgaatacagcccagaccatgttcatcacccagtccgacgtggatgccgtggcctctgtgatgaaggatgccatcctgaaggccggcaaccccaaggccttcaaggatatgaaggcagcagacctgcagaaggcagcagagctgaagggatggagaccagtgacacctgacctggccctgtttggcaggatgatcaccagcgatgccttcatggacatcgaggcctccatgcaggtggcccacgccatctctacaaataagatggatcacgagtttgactacttcaccgccgtggacgatctgcagaagtctagcgacggacctggagcagatatgatcggcgacgtgcagtttaacagcgcctgctactataagtacttctccctggactatgatgccctgatccagaacctggccggcctgaagccaggcgataatgccaccgaggccgacaagaaggcctatgccgagtccctggagaatgccaagaaggtggccgccatcaccatcacagcctttctgaaggccgccatctacaccacaccatccggcaagcagaactctttcgccgcacaccagctgccaagcgccgtgctggtggagatcaggccaaccaagacacccgtgtcctacgcaaacgccttcgtggaccccgcaaggccccgcaatggcgtggatatggtggaggacaccctgaacaagttcgtgaagcacgtggagctgcagacagagaagtttaacctgcggagcacccggagactgtggttcgtggcaggcgacaaggccctggcaggaaccgagacatgccagacaatcaacgatctgatcagcggcatcaattccgccctgtaa

SEQ ID NO: 126 - DNA, 684 bp, Methanocella arvoryzae MRE50
  misc_feature (1)..(684): Cas5
atggataacccactgctgctgctgctgcggctggagggaccaatgcagagctggggcctgaaggcaagatgggatatcagggacacaggcgatgagcccaccaagagcggcatcatcggactgctgggatgcgcactgggatacgccagaaaggaccccaggctgaccgacgagctggattcccagctgcgcatcggcatccgggtggagtgtcctggcgagatcgccagggactatcacacagtgagcggcgagctgcgcaccgcagagggcaagctgcgggagaccacaatcgtgtcctttagagattacctgcaggacgcagccttcctggtggtgctggagggaccaggagagctgctgaccaggatctccaacgccctgaaggaccccgtgtggccaatctacctgggcagaaagtcttgccctccaacaaggcccgtgttcgagaccctgaccacagactatgcctccatcgacgatgccctgagccggcacccttggagctccggcaccatggaggcaaggaaggcacacccaaaggagctgaagtgtatcgtggaggacctgtctggcccataccagagaacagataggatgaccaagagccccgccagaatgtatggcatccgccacgtgcggatgagcaccgtgaagctgcaggcagagggagagggactgtaa

SEQ ID NO: 127 - DNA, 753 bp, Methanocella arvoryzae MRE50
  misc_feature (1)..(753): Cas6
atgtacctgtctcggctgatcctgaaccctaggacccgcgccgtgaggcgcgacctggcagattgtcacgagctgcaccgcacaatcctgggcggctttccagacctgaacggcaagggaggagaggcaagggagaccttcggcgtgctgcacagaatcgatatccacccaaggagcggcgcaatcgtgctgctggtgcagagccaggagaagcccgactggtccaagctgcctgagggctacctgctggagaacaccggcacagagaatcctgcctgcaaggccatcgacgagcagtacggcaagatcaaggcaggcgacgtgtacgccttccggctgagagccaatccaacaaagaagatcggcaccagccggatcgaggatatcaaggccggcaagcccaagaacaatggccggagagtgcctatccgcaacgagagcgaccagatcctgtggctgaagaggaagggagcagcaggaggatttgagctgatgagcaccaagaggttcagcgagctgtccgacgtgctgatctccgaggagggccaccagaagatctatacattcgataccggcatcaaggccaaggtgcagaagaacgccagagagaataggctgacctttggcagcgtgctgttcgagggcacactgaaggtgaccaatgccgagaagtttctggagacactgaagagcggcatcggctccggcaaggcctacggattcggactgctgtccctggcacctgcaaggtaa

SEQ ID NO: 128 - protein, 543 aa, Methanocella arvoryzae MRE50
  misc_feature (1)..(543): Cas8
MKNRVKRGEHLVSYNLLTEPWITSIDLSGNPVQEGILATLKNAHKIDSIFDPAPPVEFGIYRLLIAFITDVFQPQGLEDLADLLDRKRLDPTALDEYAARWRDRFDLFDEKYPFLQQAITGVIKKPPEPISRLMQHLPAGTNVSHFHHGRWDENSFSFEQCAKGLVTIAPFMTAGGAGLSPSINGSPPWYVLVKGNNLFETLLYNVCQIPMTVKPIGDSPVAWRNDKRIDPGDEPKTFSIVEGLTWRPRIIQLIPGNGKGTCTYTGEKDVDTVSHMHYYPGQKSPEPGLWVDPQVAYKKTKDAIRPLRPDENKALWRDIGPLMLLQHGDYSGKDGKVSFDRPAVVTQYKQMVSNGMIKRSEPLRLEVYGIRTDGKMKIYEWYHEKLALPIEILKKANSGRQIQDAMDLADSVAYILRKAMKKAYPRNAKSNESGFDNLILSVQSSYWSHLKGQFESIFLKTLSQQDENDLDAYTKLMEQWKKILDDTGKNALDKGLGPLDTDGDSLRRQVKAMNEYSSGIRFALYPDSIQAKKKNRQKNKEDK

SEQ ID NO: 129 - protein, 196 aa, Methanocella arvoryzae MRE50
  misc_feature (1)..(196): Cse2
MTAPNENKEHQKSKKDEEFLANLAKMAESDRGGMAILKRNAGNTIAESRGAMKTFYSLLPYGISDSPYEEIYFLIATLYGHNKYRFTGDFGQTMKLVRESSNSESIDQRVSTLLDSEFNIVDGIKPGGGELAYRLRQCVKLASGHEIGVDWYRLLQDLKYWGYPEKRVQKRWARSYFGYGKPVESETKESKEEAKA

SEQ ID NO: 130 - protein, 391 aa, Methanocella arvoryzae MRE50
  misc_feature (1)..(391): Cas7
MKLIEIHMIQNHAPCNLNRDDTGSPKDCMFGGIRRSRISSQSIKRSIRMSPIFKEEMKGIELANRTRRLPELVKAKLISDGIDEKMAAIAAEKATGFGTKDGKEREEDLNTAQTMFITQSDVDAVASVMKDAILKAGNPKAFKDMKAADLQKAAELKGWRPVTPDLALFGRMITSDAFMDIEASMQVAHAISTNKMDHEFDYFTAVDDLQKSSDGPGADMIGDVQFNSACYYKYFSLDYDALIQNLAGLKPGDNATEADKKAYAESLENAKKVAAITITAFLKAAIYTTPSGKQNSFAAHQLPSAVLVEIRPTKTPVSYANAFVDPARPRNGVDMVEDTLNKFVKHVELQTEKFNLRSTRRLWFVAGDKALAGTETCQTINDLISGINSAL

SEQ ID NO: 131 - protein, 227 aa, Methanocella arvoryzae MRE50
  misc_feature (1)..(227): Cas5
MDNPLLLLLRLEGPMQSWGLKARWDIRDTGDEPTKSGIIGLLGCALGYARKDPRLTDELDSQLRIGIRVECPGEIARDYHTVSGELRTAEGKLRETTIVSFRDYLQDAAFLVVLEGPGELLTRISNALKDPVWPIYLGRKSCPPTRPVFETLTTDYASIDDALSRHPWSSGTMEARKAHPKELKCIVEDLSGPYQRTDRMTKSPARMYGIRHVRMSTVKLQAEGEGL

SEQ ID NO: 132 - protein, 250 aa, Methanocella arvoryzae MRE50
  misc_feature (1)..(250): Cas6
MYLSRLILNPRTRAVRRDLADCHELHRTILGGFPDLNGKGGEARETFGVLHRIDIHPRSGAIVLLVQSQEKPDWSKLPEGYLLENTGTENPACKAIDEQYGKIKAGDVYAFRLRANPTKKIGTSRIEDIKAGKPKNNGRRVPIRNESDQILWLKRKGAAGGFELMSTKRFSELSDVLISEEGHQKIYTFDTGIKAKVQKNARENRLTFGSVLFEGTLKVTNAEKFLETLKSGIGSGKAYGFGLLSLAPAR

SEQ ID NO: 133 - DNA, 90 bp, Methanocella arvoryzae MRE50
  misc_feature (1)..(90): CRISPR
aaagtccccacaggcgtgggggtgaaccgtgatcagtaacccggtcaccattaaacagattaaagtccccacaggcgtgggggtgaaccg

SEQ ID NO: 134 - DNA, 1701 bp, Lachnospiraceae bacterium KH1T2
  misc_feature (1)..(1701): Cas8
atgtgtgaccaacagtatgttagtacactgaatgtattaaaagatccgtggattccagttgtatttttggatggaaagataaaagatgttggaatcattgaatgctttagaaatgcagaaaagattaaaacaatatcgaattctaagccatatgaaaagattgcgatactacggtttttgacagcgttcattacggatgtatatcaactggatagacgtattgaacggcaaaagttatatgatgcgggatcatttgaaattgaacgtattgagaattatgttaaagaatgtgaagagaagaatggagcttcatttgttttgggtgattctcaaagatcttttttttgctttaactataatccgcaagttgatacagagggagtgaaattatctgcagcgtatttgcatttggaactgcctcatggcaataatcctattcacatagttgcccagagagaggaagattttgaaggtgatacgctgcctcaatttttgagggctgcattagcgtttaatttattcccgactggaaacatgttaaagggagcgaatagtaaaacgggtgataactgctatatagacggtgtggggaaagatggcaaacctaaatatacagctgcgtatggctcgatgggaataaatgcaggaagttcaatggcagcggctgaaccggttttcttttggccagaatgtgacaatttgtttcatacacttgttatgtgtatgcgcagtcaaggagaactacagaataatttaaaattaaatgatccaccagctttttggaatgccgatgcagaacctaatcctaaagcaggaaaacgtggtgatatagtaacttcagtctcttttgtgtcaggtcttgcttttcaggcaagaagaattgtaccggtcattgaaaacggaaaagtttatgaatgctatataagtaatggttataccaattcgaatgaaaacgtgtggcatgatccttttgctgttagattgagaaatcataagtcgggagaaatttttcagatgccggctaaaggggatcgagaaatgtggagaaatattggaaatttgactgcatctagagaagaaagctggcatttaatgccggatgtccttagaccaattaaaaaaagtgcagatgctacagattattatgagaatatttcttctcttgcaatgatacctatgacccagaatgcaggatacagtgctatgttctatgatgatacagtacaaattccgaaagaatatttggaagactcatatttgggtgaatatttaactacaagaatggaaatagtagaagaaatttctaagatgtgggacaagcttaaaatatcggcgcttctggataataaggataaattttcaggacattatagagatgatgcactgcaagagtattgggtcaagattcatcaatttttatttgatggcgatgatagcttcttaaatcatgtgataagaatgtatcatgaagattcttcttcttttgaaaaaacggcagataaagcattatttgaatatttaacgaagagtgttaaagaaatatgcgaaaaagaagagaagaacacgaattcatggaatatgttggtgaaaataatcaggcaaatacatggtaagaatggctgtcttcatattttttacggaacgttaaagaaatattggaagaaggagggaaaggataagaatgatacaggaagcatatga

SEQ ID NO: 135 - DNA, 498 bp, Lachnospiraceae bacterium KH1T2
  misc_feature (1)..(498): Cse2
atgatacaggaagcatatgaaaaacttgcacatgaggaaaaaaggttgtttgctcattgtgcaggtaaattaataaaagacgctccaaaagctattataccgttttataaggtggtgccaagtgaaattgaaagtaaaaacgggaaaaagtatacagttgatgaagatgctttttttgctgctttgtgtgtaagatgcctattcgaaaaaattgagggcgttacattagaacctgacatattaattagtgaaggaagaaaaaatcctaaaatatctttggaaggttatgatagaagaatttcagcattaatgtcaaatactgaagctgaattttttattccaaaacttgcaaagttaatgaattatacgctaaaaattacttctaataaaataccggattgtgatcagttatattgggatattcataatattggaagcaatgaaaaagatgttcagcgacgttgggcacgtacaatatatgtaaataatgaagagtga

SEQ ID NO: 136 - DNA, 1188 bp, Lachnospiraceae bacterium KH1T2
  misc_feature (1)..(1188): Cas7
atgagtaattcaaagtatcagttcttaaatggaaagaaacttgcagagtttcatatgttgaagctatatccgtcatcagcattaaaccgcgatgatgcaggtgagcagaaaacgggaatgtacaatggcacgcttaggaatagaatttcaagtcagtgtattaaacgttcatggaggctttctgaaactttcgaagatgtttttgatgaaattggaatacgtactaagagaatgccagaatatgttggaaaaaaattggttgagaatggagtgccggaagaggatgtaatcagttttaagaaaatcctttctggtgaaaaggttgatgaaaaatcatctaagaaaagtaaagctgatcaggctatagacgaaggtaagccagtaaagactgctgcattgtcattttattcagtggaggaacttgataaaattgctgagatatgtaaaagaatttatgatgatttggaagagcctaaatccaaaaatctgaagacaataaaaattgacaatattcagaaggaaatgcgtaagtgcgttcatccgatgaatattgatgttgcagcatttgggcgtatggtaactgacaacatgcttcgtccggtagaaggcgcaatgcaggtggcacaggcattatcaactaatgctgcggtcaaggaaaatgactattttgtggcttgcgatgatctggtaaaaggagaaaccattgaagatgtcggtggtgaaatgcttggagatattgactataattctgcatgctattatattcatgcaaatgcagatttagagcagtttgcagaaaatttgaaggattgtgaaaacatggaagaaatagtgaaagcattgccttcaaatatggtggaagtaatggcatatacagatccaacagcgagacagagtacaatggaggcgcatgttcttccagaggttatttatgtggaactaaagagtaaaaagcgtcctttgaacagaatgaaggcatttgcggaaccgtgtaatagaaatattgctgaaaagagtgctaaaaaacttgctgattatataaattgcacaaacgaaaaagctgatttaggaataacaaatgcactgtggtattgtgaggatgaaagtgttaaagcgcctgaaaatgttactgtagtgaacagtataaaagaacttgagcaaaagcttaatgagtggatgaatgaatga

SEQ ID NO: 137 - DNA, 483 bp, Lachnospiraceae bacterium KH1T2
  misc_feature (1)..(483): Cas5
atgaaaataaaaattgttttagaaggtgcatttcaagcctggggagtaccatctgaatatacttggagaggaacatcgtattatccgacagctagaggaattgtaggtttgattggatgttgtatgggtataccaaggggagatgataggcttgagcagctattatcggtgttaaaaataacatatgatataaacgaagatgataatgggaacagaaaatcaggatcaatacttacagattttcaggttgtgagaaaggaagatggcggcaagttaaatgcagcgaatggaggaactggcgattcatatggaatcatattgcataaatcctacataaatgatgcatcatttacggttcatatagagggtcctgatgatctgatgaaagatgtatatgatgcaatgcttgatccagtttgggttccatatctaggaagaaaaaattgtccgcctacagaaccacttattcctgaaattgaatag

SEQ ID NO: 138 - DNA, 618 bp, Lachnospiraceae bacterium KH1T2
  misc_feature (1)..(618): Cas6
atgtatttaacaaaattagaattaaatatacaaaacaaagctgttcttcataatatgtcaaattgtgaatggatgcataagctgattcttgaaaaaggatttggacatattcaagccgaaaatgcaagacagacgttaaagatattatatgctgtagatggcataaaagtttatgttcaaagtgctgtagaacccaaatttgaaaattgttcatattggataagtactccggctaccatttgtattgatgcgatgaaaaaaatttgtgggacaggtatggctgtacattttaaatgtacgtgtaatccaacgaaaaagttgatcgatggcggaaagcgtatttttctatcatctgagagagagagagatgagtggattaagcgtgtgatggagcgttccggagcagaagttttggttgagagtcagacttctgactttacggtatggggaatgaagaaagataaaaaaacagataaatctcacaaaatttatgctaaagcggtcacatattcaggtgcactaaaaataacagatgaagaaaaattttgggaagcattttgtaatggcataggtcgagaaaaagcttatggttgtggaatgttaatgatacaggtttga

SEQ ID NO: 139 - DNA, 1701 bp, Lachnospiraceae bacterium KH1T2
  misc_feature (1)..(1701): Cas8
atgtgcgatcagcagtacgtgtctacactgaatgtgctgaaggacccttggattcccgtggtgtttctggacggcaagatcaaggatgtgggcatcatcgagtgtttcagaaacgccgagaagatcaagaccatctctaacagcaagccatatgagaagatcgccatcctgagatttctgaccgccttcatcacagacgtgtaccagctggataggcgcatcgagaggcagaagctgtatgacgccggctctttcgagatcgagcgcatcgagaattacgtgaaggagtgcgaggagaagaacggcgccagctttgtgctgggcgatagccagcggtccttcttttgtttcaactacaatccccaggtggacaccgagggagtgaagctgagcgccgcctatctgcacctggagctgcctcacggcaacaatccaatccacatcgtggcccagagggaggaggactttgagggcgatacactgccacagttcctgagggccgccctggcctttaatctgttccctaccggcaacatgctgaagggcgccaattctaagacaggcgacaactgctacatcgatggcgtgggcaaggacggcaagcctaagtacaccgccgcctatggcagcatgggcatcaatgcaggctctagcatggcagcagcagagcccgtgttcttttggcctgagtgcgataacctgtttcacacactggtcatgtgcatgaggtcccagggcgagctgcagaacaatctgaagctgaacgatcctccagccttctggaatgcagacgcagagccaaaccctaaggcaggcaagaggggcgacatcgtgaccagcgtgagcttcgtgagcggcctggcattccaggcaaggagaatcgtgccagtgatcgagaatggcaaggtgtacgagtgttatatctctaacggctacacaaacagcaatgagaacgtgtggcacgatccatttgccgtgaggctgcgcaaccacaagtccggcgagatcttccagatgccagcaaagggcgacagggagatgtggcgcaatatcggcaacctgaccgcctccagggaggagtcttggcacctgatgccagatgtgctgcgccccatcaagaagagcgccgacgccacagattactatgagaatatctcctctctggccatgatcccaatgacccagaacgccggctacagcgccatgttctatgacgatacagtgcagatccccaaggagtacctggaggattcctacctgggcgagtatctgaccacaaggatggagatcgtggaggagatctctaagatgtgggacaagctgaagatcagcgccctgctggacaataaggataagttttccggccactacagggacgatgccctgcaggagtattgggtgaagatccaccagtttctgttcgacggcgacgattctttcctgaaccacgtgatcagaatgtaccacgaggatagctcctcttttgagaagaccgccgacaaggccctgttcgagtatctgacaaagagcgtgaaggagatctgcgagaaggaggagaagaataccaactcctggaatatgctggtgaagatcatccgccagatccacggcaagaacggctgtctgcacatcttctacggcaccctgaagaagtattggaagaaggagggcaaggacaagaacgatacaggcagcatctaa

SEQ ID NO: 140 - DNA, 498 bp, Lachnospiraceae bacterium KH1T2
  misc_feature (1)..(498): Cse2
atgatccaggaggcctacgagaagctggcccacgaggagaagcggctgtttgcccactgtgccggcaagctgatcaaggacgccccaaaggccatcatccccttctacaaggtggtgccctccgagatcgagtctaaaaacggcaagaagtataccgtggacgaggatgccttctttgccgccctgtgcgtgaggtgtctgtttgagaagatcgagggcgtgacactggagcccgatatcctgatcagcgagggccgcaagaatcctaagatctccctggagggctatgaccggagaatcagcgccctgatgtccaacaccgaggccgagttctttatccctaagctggccaagctgatgaattacaccctgaagatcacatccaacaagatcccagactgcgatcagctgtattgggatatccacaatatcggctctaacgagaaggacgtgcagaggcgctgggcaaggaccatctacgtgaacaatgaggagtaa

SEQ ID NO: 141 - DNA, 1188 bp, Lachnospiraceae bacterium KH1T2
  misc_feature (1)..(1188): Cas7
atgagcaattccaagtaccagtttctgaacggcaagaagctggccgagttccacatgctgaagctgtatcctagctccgccctgaacagagacgatgccggcgagcagaagaccggcatgtataatggcacactgaggaacagaatctctagccagtgcatcaagcggtcttggagactgagcgagacctttgaggacgtgttcgatgagatcggcatcaggacaaagcgcatgccagagtacgtgggcaagaagctggtggagaatggcgtgcccgaggaggatgtgatctcttttaagaagatcctgagcggcgagaaggtggacgagaagtcctctaagaagtccaaggccgaccaggccatcgatgagggcaagcctgtgaagaccgccgccctgagcttctactccgtggaggagctggataagatcgccgagatctgcaagaggatctatgacgatctggaggagccaaagtccaagaatctgaagacaatcaagatcgacaacatccagaaggagatgcgcaagtgcgtgcaccccatgaatatcgatgtggccgcctttggcaggatggtgaccgacaacatgctgaggcctgtggagggagcaatgcaggtggcccaggccctgtctacaaatgccgccgtgaaggagaacgattatttcgtggcctgcgacgatctggtgaagggagagaccatcgaggacgtgggaggagagatgctgggcgacatcgattacaatagcgcctgctactatatccacgccaacgccgatctggagcagtttgccgagaatctgaaggactgtgagaacatggaggagatcgtgaaggccctgccatctaatatggtggaagtgatggcctacaccgaccccacagccaggcagagcaccatggaggcccacgtgctgcccgaagtgatctacgtggagctgaagagcaagaagcggccactgaacagaatgaaggccttcgccgagccctgtaaccgcaatatcgccgagaagtccgccaagaagctggccgattacatcaattgcaccaacgagaaggccgacctgggcatcacaaatgccctgtggtattgtgaggatgagagcgtgaaggccccagagaatgtgaccgtggtgaactccatcaaggagctggagcagaagctgaatgagtggatgaacgagtaa

SEQ ID NO: 142 - DNA, 483 bp, Lachnospiraceae bacterium KH1T2
  misc_feature (1)..(483): Cas5
atgaagatcaagatcgtgctggagggagcattccaggcctggggagtgccttccgagtatacctggcggggcacatcttactatccaaccgccagaggcatcgtgggcctgatcggctgctgtatgggcatccctaggggcgacgatcgcctggagcagctgctgtccgtgctgaagatcacctacgacatcaacgaggacgataacggcaatcggaagtctggcagcatcctgacagattttcaggtggtgagaaaggaggacggaggcaagctgaatgcagcaaacggaggaaccggcgatagctacggcatcatcctgcacaagtcttatatcaatgacgccagcttcacagtgcacatcgagggccctgacgatctgatgaaggacgtgtacgatgccatgctggaccccgtgtgggtgccttatctgggcagaaagaattgccctccaaccgagccactgatccccgagattgaataa

SEQ ID NO: 143 - DNA, 618 bp, Lachnospiraceae bacterium KH1T2
  misc_feature (1)..(618): Cas6
atgtacctgaccaagctggagctgaatatccagaacaaggccgtgctgcacaatatgtctaactgcgagtggatgcacaagctgatcctggagaagggctttggccacatccaggccgagaatgcccggcagacactgaagatcctgtacgccgtggatggcatcaaggtgtatgtgcagtccgccgtggagcccaagttcgagaactgttcttactggatcagcacccctgccacaatctgcatcgacgccatgaagaagatctgtggcaccggcatggccgtgcactttaagtgcacctgtaaccccacaaagaagctgatcgatggcggcaagagaatcttcctgagctccgagcgggagagagacgagtggatcaagagagtgatggagagaagcggcgccgaggtgctggtggagtctcagaccagcgatttcacagtgtggggcatgaagaaggacaagaagaccgataagtcccacaagatctacgccaaggccgtgacctattctggcgccctgaagatcacagacgaggagaagttttgggaggccttctgcaatggcatcggccgggagaaggcctacggctgtggcatgctgatgatccaagtctaa

SEQ ID NO: 144 - protein, 566 aa, Lachnospiraceae bacterium KH1T2
  misc_feature (1)..(566): Cas8
MCDQQYVSTLNVLKDPWIPVVFLDGKIKDVGIIECFRNAEKIKTISNSKPYEKIAILRFLTAFITDVYQLDRRIERQKLYDAGSFEIERIENYVKECEEKNGASFVLGDSQRSFFCFNYNPQVDTEGVKLSAAYLHLELPHGNNPIHIVAQREEDFEGDTLPQFLRAALAFNLFPTGNMLKGANSKTGDNCYIDGVGKDGKPKYTAAYGSMGINAGSSMAAAEPVFFWPECDNLFHTLVMCMRSQGELQNNLKLNDPPAFWNADAEPNPKAGKRGDIVTSVSFVSGLAFQARRIVPVIENGKVYECYISNGYTNSNENVWHDPFAVRLRNHKSGEIFQMPAKGDREMWRNIGNLTASREESWHLMPDVLRPIKKSADATDYYENISSLAMIPMTQNAGYSAMFYDDTVQIPKEYLEDSYLGEYLTTRMEIVEEISKMWDKLKISALLDNKDKFSGHYRDDALQEYWVKIHQFLFDGDDSFLNHVIRMYHEDSSSFEKTADKALFEYLTKSVKEICEKEEKNTNSWNMLVKIIRQIHGKNGCLHIFYGTLKKYWKKEGKDKNDTGSI

SEQ ID NO: 145 - protein, 165 aa, Lachnospiraceae bacterium KH1T2
  misc_feature (1)..(165): Cse2
MIQEAYEKLAHEEKRLFAHCAGKLIKDAPKAIIPFYKVVPSEIESKNGKKYTVDEDAFFAALCVRCLFEKIEGVTLEPDILISEGRKNPKISLEGYDRRISALMSNTEAEFFIPKLAKLMNYTLKITSNKIPDCDQLYWDIHNIGSNEKDVQRRWARTIYVNNEE

SEQ ID NO: 146 - protein, 395 aa, Lachnospiraceae bacterium KH1T2
  misc_feature (1)..(395): Cas7
MSNSKYQFLNGKKLAEFHMLKLYPSSALNRDDAGEQKTGMYNGTLRNRISSQCIKRSWRLSETFEDVFDEIGIRTKRMPEYVGKKLVENGVPEEDVISFKKILSGEKVDEKSSKKSKADQAIDEGKPVKTAALSFYSVEELDKIAEICKRIYDDLEEPKSKNLKTIKIDNIQKEMRKCVHPMNIDVAAFGRMVTDNMLRPVEGAMQVAQALSTNAAVKENDYFVACDDLVKGETIEDVGGEMLGDIDYNSACYYIHANADLEQFAENLKDCENMEEIVKALPSNMVEVMAYTDPTARQSTMEAHVLPEVIYVELKSKKRPLNRMKAFAEPCNRNIAEKSAKKLADYINCTNEKADLGITNALWYCEDESVKAPENVTVVNSIKELEQKLNEWMNE

SEQ ID NO: 147 - protein, 160 aa, Lachnospiraceae bacterium KH1T2
  misc_feature (1)..(160): Cas5
MKIKIVLEGAFQAWGVPSEYTWRGTSYYPTARGIVGLIGCCMGIPRGDDRLEQLLSVLKITYDINEDDNGNRKSGSILTDFQVVRKEDGGKLNAANGGTGDSYGIILHKSYINDASFTVHIEGPDDLMKDVYDAMLDPVWVPYLGRKNCPPTEPLIPEIE

SEQ ID NO: 148 - protein, 205 aa, Lachnospiraceae bacterium KH1T2
  misc_feature (1)..(205): Cas6
MYLTKLELNIQNKAVLHNMSNCEWMHKLILEKGFGHIQAENARQTLKILYAVDGIKVYVQSAVEPKFENCSYWISTPATICIDAMKKICGTGMAVHFKCTCNPTKKLIDGGKRIFLSSERERDEWIKRVMERSGAEVLVESQTSDFTVWGMKKDKKTDKSHKIYAKAVTYSGALKITDEEKFWEAFCNGIGREKAYGCGMLMIQV

SEQ ID NO: 149 - DNA, 90 bp, Lachnospiraceae bacterium KH1T2
  misc_feature (1)..(90): CRISPR
gtattccccacgcacgtgggggtaaatccgctgagtttaattacgcagcggaagccggagcggtattccccacgcacgtgggggtaaatc

SEQ ID NO: 150 - DNA, 1524 bp, Klebsiella pneumoniae strain VRCO0172
  misc_feature (1)..(1524): Cas8
atggagaaccgcttcaatttgattgatgaaccctggattgcggtcgtggatgtggggttggtcagtttaaccgatattttcagccagccggaattacgcgctttaggtgggaatccggtagaaaaaatcgcgctcactaaattgctactcgccatcgcccaggcagcagcgacgccgacagatgatagcgactggcagcagatgggctggcagggaatggcccattgctgcctgcagtaccttgctaaatggcatgaccgtttttatctgtatggcgaaaagccgttcttacagatgcccgctattcaggccgcggaatgtaagtcattgggagtattatcaccggaggtgagtaccggcaataccaccgttttgaccgaaagtcagcaacagcagcaattaactgatgcagacaaagcgctagctattgttatgcaaatgggctttgggctcggaggcaagaaaaccgataactctgtggtattaacgccgggctatcggggtaaacaaaacgacaagggaaagccgggcagtggaaaggccggggtttctgtcgggcatatgggattgttacattcgttctggcaggggaattcaatcgtacagagcatttggctcaatttgtttaccgctgaggatattacgcagctggcgatgtatcccacgctggggactgctccctgggagcgaatgccgacaggggaagatgatgacattgcgcgctcgttgaaagcgtcgttgctgggccgcttgatcttgatgggtaaattttgtctgttagctgaggacggcattcactatagcgatggaataagccatgccggttatctggagggcaaaaccgacccctcggtgtccgtcgatttttcaggaaagaaaccaaaggcgttatgggttaatccgggtaaacgcccctggcgcgaactgacgtcgttattgcagtttattgagcaagatagcccccggggatatgaaacccgtcagcttagccttcctctgaagcggataacccatcatgcggagcagtttgcgctatggtcaggcggcttaagggtgagtagtaatgcgggggaacagtacgcttcagggaccgatgattatgttcagtcagaaatatggttgtcatcagatttaatcaatcacacatttttagagtatttaaaatatgaaatgacgcagcttgatgctgtgcaaaaacagctttggggtgcagttgtacgttattttcgccagctatcagatattgataaatcagcgacagggaaggctcaaccctttgtggcaaagcaggccgaaaaagcgacgacgatattctggcaactttgtgaacgtcaggctcagaccctaattaatgcttgcttgaattccggtgaagaccataccgcgcgtcttcagttacgaaaaatttttgccaggtacgccgggcaggtttttgatcagctctgtcccgccgacagtgcccgtcaattagatgcctgggcgctggcccggcctaatttttcccaatatctcaccctcgattaa

SEQ ID NO: 151 - DNA, 567 bp, Klebsiella pneumoniae strain VRCO0172
  misc_feature (1)..(567): Cse2
atggatcaggttcctgcagacgttaccgccgaaagcgccggtaacgaatcgcctgccaaacgatttgtcggttacgtgattgagcgtatcgcgaaagacaatggctttgccgcccgccttaaacgagcggataacccggcgaccgagtatcagagctgggaaatcctggcggggtttggcattgacctggaaaaagagtggcaacgcctgccgtactgcgtcattggcgccgcgctggcaaaggcgaaaccggccagcaatggcacaatcactctgggggccgccattgccggttgttatcccgaaggcaatcagtctgaacaggcgaaagctcgcctgcgacggctgttggcctgtacttcgaccagcgaagcgtgccgtattttgcgcccgttgttggcattaatggccagccgcagtgtgacgccggatttcgcagggctactcaacgaactgcagtggttctccggcagcagtcgcgaacggatccgcgcccgctgggcgcaggaattctatcgtcgtgccggtgaggctgccgggagtgaggcgaggaattcacatgactga

SEQ ID NO: 152 - DNA, 1035 bp, Klebsiella pneumoniae strain VRCO0172
  misc_feature (1)..(1035): Cas7
atgactaccccgttcagaaacacccgtattgagtttcatattctgcagtctttcccggtgacctgccttaaccgcgatgacgtgggcgcccccaagtccgccatcgttggcggtgtgtcgcgcgccagagtgtcatcgcagtgctggaagcgccaggtgcgtctggcgctgcctgattttggtattcgtctcggggtgcgtagtaaaaaaactgcctcactgctggccaacgcctgtcgcgcactgggagcgagcgaagaacaggccaccggatgcggtgaagcgatggccgcttttttctccgatgataccctgctgtttctcagcgaggctgaggccgccgcatttgccgcttatgcgcagggaaaagattttgacgccgccagcctgaaagacaaagagctggtcaaagtcgccaaaaaggtggttaacaataccctggatgccctggatattgcgcttttcgggcgcatggtggccaaagcggcggatatgaacgttgaggcggcggcatcgttcgcgcatgccatttccacccataaagtgagtaatgagatcgagttttttaccgccgtggatgactgtaaaacggaggatgaaagcggttcggcacatatgggcagcctggagtttaattcggcgacctactatcgctatgtcagcttggatctcgggcaactggcgcagacgttgggtgaggacgccgatatgaaaaccgccgtcgccgcttttgttaaggcactctatgtcgccgtcccctcagcccgacagacaacgcagtccggggcctgcccgtgggaatatgcccgcgtgttactgcgtaaaggtcagggtctgcaggcttcattcgagcagccagttaagagtcagggtgaaggcttcttatctcccagtaaagcggcgctcaaaaactggttgcatacaaaagaaaaactctctggctccttgttcggcaaacaaggcgattatgagtggggtgaggacctcgactacagcattgaccgcctgatcgctgacttacagtcacatctgtaa

SEQ ID NO: 153 - DNA, 717 bp, Klebsiella pneumoniae strain VRCO0172
  misc_feature (1)..(717): Cas5
atgagacaaactacgcaatatatgctgctgtggcttgaagggccgctgcagtcctgggggggcgattcaaagttcggtgtgcgcgatacgctgaatttcccgactcgctcgggcattctggggctgatttgctgtgcacgaggcgccgcggggccagaggtcgagtggctggcggagatgaataacctgccgatggaggttcgcgcctacgcccgaaccgacaaggagggccagccgctcctgcgcgagccgacattgtgcgatttccagatggttggcagcggatatgacgacagcgatccgtggcaaagtctgctgatccctaaaacatccgatggaaagaaagccgtagggggtggaacgaaaatgacctaccgccactatctccaggatgccgtattcgccgtggtaatgggacttggcagccagcaagccgagtcgttaccagaggcgctacaaaatccggtatgggatttatatctcggtcgtaaaagctgcgtgcccagcgagctgatctatcagggcatctatgacagcgcagaagcggcatggcagcaggccaggacattagctgagagtaagcggcgcacgctgagttacaaggtcattgaaggggaaggggatggcgatgtcatcacgcttaatgatgtcccggtgcagttcggccggcataagcgttaccgggatcgtcaggtgaccgtgctggagtgcggctaa

SEQ ID NO: 154 - DNA, 648 bp, Klebsiella pneumoniae strain VRCO0172
  misc_feature (1)..(648): Cas6
atgactgacctctttgcgagtgctttacatctcgatcgcgctgcggtgaaagcgctgaaaataagcgatgcctactccctacaccgggtggtgtacagcctgtttgctgacgcgcgtacagaccgggagaagtgcagccatatttcgagcgggatcgcctatgccgaccagggcggggattttcatggccgcaaaatattgatcgtctctgacagacttccggctgcaaaggttgatggcctgtacggtgaggtcatcagtaaatcgattccggccgcctttctctcccattcgcgttatcgctttcaggtacaagtgaatccggtacggaaagataagcaaacgggtaaacgcgtcgcggtgaaaggccgggccgatattgcgcagtggtttattcagcgagccgccagccgctggggctttgacgttgaccttcctggcttgcaggttgaggcgatggaagtgctgcagtttaaagataaaggcggccgccaggtaacgcttggcaaggcgacggtgcaggggctgctcaccgtcaccgaccgacagaagttccagcatagttttcatcatggcattggtaaagggcgagcctttggctgcggcctgctgcagattgtgcccgttgttgatgcgcttttttcctga

SEQ ID NO: 155 - DNA, 1524 bp, Klebsiella pneumoniae strain VRCO0172
  misc_feature (1)..(1524): Cas8
atggagaacaggttcaatctgatcgacgagccctggatcgccgtggtggatgtgggcctggtgtccctgaccgacatcttttctcagccagagctgcgcgccctgggaggaaatcctgtggagaagatcgccctgacaaagctgctgctggcaatcgcacaggcagcagcaacccctacagacgattccgactggcagcagatgggatggcagggaatggcacactgctgtctgcagtacctggccaagtggcacgatcggttctacctgtatggcgagaagcccttcctgcagatgcctgccatccaggcagcagagtgcaagtccctgggcgtgctgagccctgaggtgtccaccggcaacaccacagtgctgacagagtctcagcagcagcagcagctgaccgatgccgacaaggccctggccatcgtgatgcagatgggcttcggcctgggcggcaagaagaccgacaacagcgtggtgctgacacccggctatcggggcaagcagaatgataagggcaagcctggcagcggcaaggcaggcgtgtccgtgggacacatgggcctgctgcactccttctggcagggcaactctatcgtgcagagcatctggctgaatctgtttaccgccgaggacatcacacagctggccatgtacccaaccctgggcacagccccatgggagagaatgcccaccggcgaggacgatgacatcgccagatccctgaaggcctctctgctgggcaggctgatcctgatgggcaagttctgtctgctggccgaggatggcatccactacagcgacggcatctcccacgccggctatctggagggcaagaccgatcccagcgtgtccgtggacttcagcggcaagaagcctaaggccctgtgggtgaatccaggcaagagaccctggagggagctgacatctctgctgcagtttatcgagcaggacagcccacgcggctatgagacccggcagctgagcctgcccctgaagagaatcacacaccacgcagagcagtttgcactgtggtccggcggactgagggtgagctccaacgcaggagagcagtacgccagcggcaccgatgactatgtgcagtccgagatctggctgtctagcgacctgatcaatcacaccttcctggagtacctgaagtatgagatgacacagctggatgcagtgcagaagcagctgtggggagcagtggtgcgctactttcggcagctgtccgatatcgacaagtctgccacaggcaaggcacagcccttcgtggcaaagcaggcagagaaggccaccacaatcttttggcagctgtgcgagaggcaggcacagaccctgatcaacgcctgtctgaatagcggcgaggaccacacagccagactgcagctgaggaagatctttgccagatatgccggccaggtgttcgatcagctgtgccctgccgactccgccaggcagctggatgcctgggcactggcccggccaaacttctctcagtacctgaccctggattaa

SEQ ID NO: 156 - DNA, 567 bp, Klebsiella pneumoniae strain VRCO0172
  misc_feature (1)..(567): Cse2
atggatcaggtgcctgcagacgtgacagcagagtctgccggcaatgagagcccagccaagcggttcgtgggctatgtgatcgagcggatcgccaaggataacggatttgcagcacgcctgaagagggcagacaatccagccaccgagtatcagtcctgggagatcctggccggcttcggcatcgacctggagaaggagtggcagcgcctgccatactgcgtgatcggagccgccctggcaaaggcaaagcctgcctctaacggaaccatcacactgggagcagcaatcgcaggatgttaccccgagggcaatcagagcgagcaggcaaaggcaaggctgcggagactgctggcatgcacctccacatctgaggcctgtagaatcctgaggccactgctggccctgatggcaagccgctccgtgacccccgacttcgcaggactgctgaacgagctgcagtggtttagcggctctagcagggagcgcatccgggcaagatgggcacaggagttttataggagggcaggagaggcagcaggctctgaggccagaaacagccacgactaa

SEQ ID NO: 157 - DNA, 1035 bp, Klebsiella pneumoniae strain VRCO0172
  misc_feature (1)..(1035): Cas7
atgaccacacccttccgcaacacccggatcgagtttcacatcctgcagagcttccctgtgacatgcctgaatagagacgatgtgggagcaccaaagtctgccatcgtgggaggcgtgagccgggccagagtgagctcccagtgttggaagagacaggtgaggctggccctgcctgactttggcatcagactgggcgtgaggtctaagaagaccgccagcctgctggcaaacgcctgccgggccctgggagccagcgaggagcaggccaccggctgtggcgaggccatggccgccttcttttctgacgatacactgctgtttctgagcgaggcagaggcagcagccttcgccgcctacgcccagggcaaggattttgacgccgccagcctgaaggacaaggagctggtgaaggtggccaagaaggtggtgaacaataccctggatgccctggacatcgccctgttcggcagaatggtggccaaggcagcagatatgaacgtggaggcagcagcctcctttgcccacgcaatctccacacacaaggtgtctaatgagatcgagttctttaccgccgtggacgattgcaagacagaggacgagtccggctctgcccacatgggcagcctggagttcaactccgccacctactatagatacgtgtccctggatctgggacagctggcacagaccctgggagaggatgccgacatgaagacagccgtggccgcctttgtgaaggccctgtacgtggcagtgccatccgccagacagaccacacagtctggcgcctgtccttgggagtatgcccgcgtgctgctgcggaagggacagggactgcaggccagcttcgagcagcctgtgaagtcccagggcgagggctttctgagcccatccaaggccgccctgaagaattggctgcacaccaaggagaagctgtctggcagcctgttcggcaagcagggcgactacgagtggggcgaggatctggactatagcatcgatcgcctgatcgcagacctgcagtcccacctgtaa

SEQ ID NO: 158 - DNA, 717 bp, Klebsiella pneumoniae strain VRCO0172
  misc_feature (1)..(717): Cas5
atgaggcagaccacacagtacatgctgctgtggctggagggaccactgcagtcctggggaggcgactctaagtttggcgtgagagataccctgaatttccctacaaggtccggcatcctgggcctgatctgctgtgcaaggggagcagcaggccctgaggtggagtggctggccgagatgaacaatctgccaatggaggtgagagcctatgccaggaccgacaaggagggacagcctctgctgagggagccaacactgtgcgatttccagatggtgggcagcggctacgacgattccgacccctggcagtctctgctgatccctaagaccagcgatggcaagaaggcagtgggaggaggaaccaagatgacatacaggcactatctgcaggatgccgtgtttgcagtggtcatgggactgggcagccagcaggcagagtccctgcctgaggccctgcagaacccagtgtgggacctgtacctgggccggaagtcttgcgtgcctagcgagctgatctaccagggcatctatgattccgccgaggcagcatggcagcaggcaagaaccctggccgagagcaagcggagaacactgtcctataaagtgatcgagggcgagggcgatggcgacgtgatcaccctgaacgacgtgcctgtgcagttcggccgccacaagaggtaccgcgataggcaggtcaccgtgctggagtgcggataa

SEQ ID NO: 159 - DNA, 648 bp, Klebsiella pneumoniae strain VRCO0172
  misc_feature (1)..(648): Cas6
atgaccgatctgtttgcatctgccctgcacctggacagggcagcagtgaaggccctgaagatctccgatgcctactctctgcaccgggtggtgtatagcctgttcgcagatgcaaggacagacagggagaagtgctcccacatctcctctggcatcgcatacgcagatcagggaggcgactttcacggacgcaagatcctgatcgtgagcgacaggctgccagcagcaaaggtggatggactgtacggcgaagtgatctctaagagcatccctgccgcctttctgtcccacagccggtataggttccaggtgcaagtgaatccagtgaggaaggacaagcagaccggcaagagagtggccgtgaagggcagggccgatatcgcacagtggttcatccagagggcagcatcccggtggggctttgatgtggacctgccaggactgcaggtggaggcaatggaggtgctgcagttcaaggacaagggaggccgccaggtgaccctgggcaaggcaacagtgcagggactgctgaccgtgacagatagacagaagtttcagcactctttccaccacggaatcggcaagggaagggccttcggctgcggactgctgcagatcgtgccagtggtggacgccctgtttagctaa

SEQ ID NO: 160 - protein, 507 aa, Klebsiella pneumoniae strain VRCO0172
  misc_feature (1)..(507): Cas8
MENRFNLIDEPWIAVVDVGLVSLTDIFSQPELRALGGNPVEKIALTKLLLAIAQAAATPTDDSDWQQMGWQGMAHCCLQYLAKWHDRFYLYGEKPFLQMPAIQAAECKSLGVLSPEVSTGNTTVLTESQQQQQLTDADKALAIVMQMGFGLGGKKTDNSVVLTPGYRGKQNDKGKPGSGKAGVSVGHMGLLHSFWQGNSIVQSIWLNLFTAEDITQLAMYPTLGTAPWERMPTGEDDDIARSLKASLLGRLILMGKFCLLAEDGIHYSDGISHAGYLEGKTDPSVSVDFSGKKPKALWVNPGKRPWRELTSLLQFIEQDSPRGYETRQLSLPLKRITHHAEQFALWSGGLRVSSNAGEQYASGTDDYVQSEIWLSSDLINHTFLEYLKYEMTQLDAVQKQLWGAVVRYFRQLSDIDKSATGKAQPFVAKQAEKATTIFWQLCERQAQTLINACLNSGEDHTARLQLRKIFARYAGQVFDQLCPADSARQLDAWALARPNFSQYLTLD

SEQ ID NO: 161 - protein, 188 aa, Klebsiella pneumoniae strain VRCO0172
  misc_feature (1)..(188): Cse2
MDQVPADVTAESAGNESPAKRFVGYVIERIAKDNGFAARLKRADNPATEYQSWEILAGFGIDLEKEWQRLPYCVIGAALAKAKPASNGTITLGAAIAGCYPEGNQSEQAKARLRRLLACTSTSEACRILRPLLALMASRSVTPDFAGLLNELQWFSGSSRERIRARWAQEFYRRAGEAAGSEARNSHD

SEQ ID NO: 162 - protein, 344 aa, Klebsiella pneumoniae strain VRCO0172
  misc_feature (1)..(344): Cas7
MTTPFRNTRIEFHILQSFPVTCLNRDDVGAPKSAIVGGVSRARVSSQCWKRQVRLALPDFGIRLGVRSKKTASLLANACRALGASEEQATGCGEAMAAFFSDDTLLFLSEAEAAAFAAYAQGKDFDAASLKDKELVKVAKKVVNNTLDALDIALFGRMVAKAADMNVEAAASFAHAISTHKVSNEIEFFTAVDDCKTEDESGSAHMGSLEFNSATYYRYVSLDLGQLAQTLGEDADMKTAVAAFVKALYVAVPSARQTTQSGACPWEYARVLLRKGQGLQASFEQPVKSQGEGFLSPSKAALKNWLHTKEKLSGSLFGKQGDYEWGEDLDYSIDRLIADLQSHL

SEQ ID NO: 163 - protein, 238 aa, Klebsiella pneumoniae strain VRCO0172
  misc_feature (1)..(238): Cas5
MRQTTQYMLLWLEGPLQSWGGDSKFGVRDTLNFPTRSGILGLICCARGAAGPEVEWLAEMNNLPMEVRAYARTDKEGQPLLREPTLCDFQMVGSGYDDSDPWQSLLIPKTSDGKKAVGGGTKMTYRHYLQDAVFAVVMGLGSQQAESLPEALQNPVWDLYLGRKSCVPSELIYQGIYDSAEAAWQQARTLAESKRRTLSYKVIEGEGDGDVITLNDVPVQFGRHKRYRDRQVTVLECG

SEQ ID NO: 164 - protein, 215 aa, Klebsiella pneumoniae strain VRCO0172
  misc_feature (1)..(215): Cas6
MTDLFASALHLDRAAVKALKISDAYSLHRVVYSLFADARTDREKCSHISSGIAYADQGGDFHGRKILIVSDRLPAAKVDGLYGEVISKSIPAAFLSHSRYRFQVQVNPVRKDKQTGKRVAVKGRADIAQWFIQRAASRWGFDVDLPGLQVEAMEVLQFKDKGGRQVTLGKATVQGLLTVTDRQKFQHSFHHGIGKGRAFGCGLLQIVPVVDALFS

SEQ ID NO: 165 - DNA, 89 bp, Klebsiella pneumoniae strain VRCO0172
  misc_feature (1)..(89): CRISPR
gtcttccccacacgcgtgggggtgtttccggctcttttttatctccttcatccttcgctatgtcttccccacacgcgtgggggtgtttc

SEQ ID NO: 166 - DNA, 1569 bp, Pseudomonas aeruginosa DHS01
  misc_feature (1)..(1569): Cas8
atgactgaacactacaacctgctggataccccctggctgccggtccgcctggcgaacggcgaggtccgcgagatggggctgctggaggtgtaccgcgaggccgagcgtatcagcgccctggcggaaaccgagccgccgagtctgattgcacagtaccgcctgctgctggccattacccaccgggcgcttttgctggagtacggcgcgtggaaggatagtggcaggctgcgttggttccgcgaggggttgcccattgacgtcgtggaacgctacctggagcgttggcgagagcgtttctggctgttccatccacagtatccgttcatgcaagtcgcggccttggctagcgccgcggaaacctgcgacaaacagaagccctgggcccagatttccctggccagcgccaacggcaatacccctgtcgtgttcgaccactcctatgacctggcgccttccgcggtgagtgcggaccgggcgttgtgcgccttgctgggcttcctacagttcactccgggcgggttggtcaagactgttcgcgattcggacaaagccggcgcactggccaatacggcggcggtggtacccctggcggacagtctggcgaaaaccctgtgcctggccttgcacccggcctcgggcgaagcagccttcgatttgcctgcctgggagcgggaagccttgacgattccgcaactggccgccgaccccattcttgccagcgggcctaacgatcgctacacccggcagtcgcgagcagtgttgttgctgccggaggaagagggctgcgtccgctggattcgtttcgccgccggccaggcgctggccgacgatgtccaggcgccggaccccatggccagctaccgccccggcgccaacaacagcatggtccggctgagcttcggtgaagggcgggtgttctggcgcgacctgccgagcttgctgccggacagcgcggcggctggctcgaaacgggctgccgttctcgactgggcttccaacctgcgcagcatcggcgccgatgcgccgtcctcgatgctgctggtcgccggattggccagcgaccaggccaaactgttgcgctggcgctccgagaccgttgtcctgcctgcggccctgctcgactcggagggctgtgccaacgaactgcgccgttgtatccgggaatcggaagacctgtacggcgaactgcgcaagatcgccgtggcaatgctcgccgaggcgttgcccgatcctgccagcaaggacacctgggcgagggctcgtacgtcgtttgacaacggtccggctgcggccacctatttcgccttgctggagcgctcgttgccctcgctcatggccctcatcggcggcgataggttggagatgctggacgaagccgaggcgttctggcgaagccgcctgctggcagccctcgaggtcgcctggcagggcgtgcgggaaggcctgggcctgtcggtcgcagcgttgcgtgcggaggccaaggtccggccgcgctacctggcgttgctgcgtcgttaccgtagcgaacgtacctcttccactccacttgcagaggagcagtgtgcatga

SEQ ID NO: 167 - DNA, 531 bp, Pseudomonas aeruginosa DHS01
  misc_feature (1)..(531): Cse2
atgagtgctgccgaacatcctttcatcggccatctgcagcgcttgcagaatgatcgcggtgcgctggccgttctacggcgcagcctgggcttcgcgccgggtgcctatgtgccggcctatccctatgtggaacgcttcgtcggtgccgagaggcatgcgcaggatgcctggcgcctggcactgtatctgaccgccggattgttcgccagccatcccggacaggggcgggcgagcctggcgatgcgcttcggcgaactgatgaaagcgcgcaacagcgcgagcatcgaaaagcgtttcatcgccttgctggctgccgatgcggaaaacctgccggtgtatctgcgccaggccgtgagcctgttggcggcggacaagctcgccttcgactatggcgccttgctcgacgaccttgcccattggctcgacccttacctgcctgttgcgcgcggcgacgccattcgccagcgctgggccagggatttctacgcggcgctggccaacacaaccgacacctcccttcacaaggattga

SEQ ID NO: 168 - DNA, 1143 bp, Pseudomonas aeruginosa DHS01
  misc_feature (1)..(1143): Cas7
atgaatttgttcatcgagttccatctgatccagaacttcgctccgtccaacctcaaccgtgacgataccggagcgcccaaggatgccatctttggcggtcaccgtcgggctcgcgtcagcagccagtgcttcaagcgtgcgatccgcctgactgcccacgagcaggagttggtcgcgcccgaacatcgcggcgtgcgcaccaagaagctcaaggcattgctgctggagcggcttgccggacgcgatcccgccgaggccgagggcaagatcgagacggcgctggcggccgcggggctcaagctcaaggacgatggcaagaccgaatacctgctgtttctcggcgaagcggagattgccggtttcgccgcgctgatcgagcagcgctgggatgaactgggcagcgccgcgccggctggcgagaaaaagggcaagaaggaagccaaggcgaacgtgccgacggaagtgatcaagcaggccagggccctgctcgacggtggcaaggccgttgacgtggcgctgttcgggcggatgctcgccgatctgcccgaagtcaatcaggacgcggcctgccaggtggcccatgcgatcagtacccatcgtgtcgagcgcgagttcgattacttcaccgccgtcgacgatcgcggtggcccggacgaaagcggcgccggcatgatcggccaggtggagttcaattccgccacgctgtatcgctacgcagtggtcgacctgcgcaagttgctcggcaacctgcagaacgacggcgagctggtgctgtcggcgctggaagcgttcacccaggccatggtccgggcgatcccgtcgggcaagcagaacaccttcgcggcgcacaacctgccggccttcgtcggtatctgcttgcgccacgcgggcccgctgaacctggccaacgcctttgagaaaccggtcgtcgcgcgtgccgatgcctccctcagcgagcgctccgttgccgagttggcccgccacgaccagcaattggcctcggtctatggtgacagccgcgaccgctgggcttatctggacatcagcggtgcctggccgaaggagcgtggcgagccggccggcaacctgcagcaactcgccgattggctgcgcagccaggtttccagccgtctgggaggctga

SEQ ID NO: 169 - DNA, 663 bp, Pseudomonas aeruginosa DHS01
  misc_feature (1)..(663): Cas5
atggctaccttgctgatgcgcctgcaagggccgatgcagtcatggggcaccaccagccgttttgacgagcgcgacactcagctggaaccgtcgaagtcgggagtgcttggcctggtctgcgccgccctgggacgtgatcgcagcgagccgctggaggatctggccagcctgcggatgggggtgcgcgtcgaccgagagggcattccgttgcgcgactaccagacggccaccggtgtgctggtcgccagtggcaaggccgatccgcggcggacagtggtcagcccgcggcattacctggccgacgcggtctttctggtcgggctcgaagggcgcgaccaggccctgctggagcgaatccagcaagccttgcgtgcaccgttctggccgctgtgcctgggccgcaagagtttcgttcctgggagcccggtgtggttgcccgagggcctttcttccctggcactggaacaggcgttgcaggcctggccacgcctggccgaggcgcaaccgggcgaccgcggcaagcccttgcgttgcctgatcgaggatgagcgcagcggggtggtacgcctcgatcagcccatcgccccctttgccgaacgccgtttcggcccacgcttcgtacgctcgggagtcgcggatgtacctgaccagactgacccttga

SEQ ID NO: 170 - DNA, 612 bp, Pseudomonas aeruginosa DHS01
  misc_feature (1)..(612): Cas6
atgtacctgaccagactgacccttgatcctcgcagcgctcaggcgcgccgcgacctaggcgacgcctatgagatgcaccgtactttgtcgcgggttttcgccgacgagcaggctccggcatcgcgcttcctctggcgtctggaggcctcggggaatgcctggtccactccgaccttgctggtccaggcggccagcgagggtaactggtcggtgctgcaggcgctccctggctacctgctgggggagccgcagagcaaatctctggctttgcgacagtggctggaaagcgatatctcctaccgtttcagattgttcgccaatccgacggtgacacgccagggcaagcgctatgggctggtgggcgaggagcagcaactggcttggctggcacgccagggcgagcggcacggtttcgtggtcgaggcggccctcgtaaccttcagcgaagtgcttggcagccgcaagaggcagacacgcatcagcgtcttgcgcgccgcgttcgaggggcgtttgcggatcagtcgcccggatgcctttggtcaggctctggtcgctgggataggccctgccaaggctttcggctgtggcctgctgagcctggcgcgtagctga

SEQ ID NO: 171 - DNA, 1569 bp, Pseudomonas aeruginosa DHS01
  misc_feature (1)..(1569): Cas8
atgaccgagcactataacctgctggacacaccatggctgcctgtgcggctggcaaatggagaggtgagagagatgggcctgctggaggtgtacagggaggcagagaggatctctgccctggcagagaccgagccacccagcctgatcgcccagtaccggctgctgctggccatcacacacagagccctgctgctggagtatggagcatggaaggactccggccggctgagatggtttagggagggcctgcctatcgatgtggtggagcggtacctggagcggtggagggagcggttttggctgttccacccacagtatcccttcatgcaggtggccgccctggcaagcgccgcagagacctgcgataagcagaagccatgggcacagatcagcctggcatccgccaacggcaatacacctgtggtgttcgatcactcctacgacctggccccatctgccgtgagcgccgaccgggccctgtgcgcactgctgggctttctgcagttcaccccaggaggactggtgaagacagtgcgcgacagcgataaggcaggcgccctggcaaacaccgcagcagtggtgccactggcagacagcctggcaaagacactgtgcctggccctgcacccagcatccggcgaggcagcctttgatctgcctgcctgggagagagaggccctgaccatcccacagctggcagccgaccctatcctggcatccggcccaaatgatcgctatacacggcagagccgggccgtgctgctgctgcccgaggaggagggctgcgtgcggtggatcagattcgcagcaggacaggccctggcagacgatgtgcaggcccctgacccaatggccagctacaggcctggcgccaacaattccatggtgcgcctgtcttttggcgaaggccgggtgttctggagagatctgcctagcctgctgccagactccgccgcagcaggctctaagagggcagccgtgctggactgggcaagcaacctgcgctccatcggagcagatgcacctagctccatgctgctggtggcaggactggcaagcgatcaggccaagctgctgagatggaggtccgagaccgtggtgctgccagccgccctgctggactctgagggatgcgcaaacgagctgcggagatgtatccgggagagcgaggatctgtatggcgagctgagaaagatcgcagtggcaatgctggcagaggccctgcccgatcctgcatctaaggacacctgggcaagggcacggaccagcttcgacaatggaccagcagcagcaacatacttcgcactgctggagaggtccctgccttctctgatggccctgatcggcggcgatcgcctggagatgctggacgaggcagaggccttctggagatctaggctgctggccgccctggaggtggcatggcagggcgtgcgggagggactgggcctgagcgtggccgccctgagagcagaggcaaaggtgcgcccaaggtacctggccctgctgaggcgctatcggagcgagagaacctctagcacacccctggccgaggagcagtgcgcctaa

SEQ ID NO: 172 - DNA, 531 bp, Pseudomonas aeruginosa DHS01
  misc_feature (1)..(531): Cse2
atgtccgccgcagagcacccattcatcggacacctgcagaggctgcagaatgacaggggcgccctggccgtgctgaggcgcagcctgggatttgcacctggagcatatgtgccagcatacccatatgtggagcggttcgtgggagcagagagacacgcacaggatgcctggaggctggccctgtacctgaccgcaggactgtttgcatcccacccaggacagggaagggcctctctggcaatgaggttcggagagctgatgaaggccaggaacagcgcctccatcgagaagcggttcatcgccctgctggcagcagacgcagagaatctgcccgtgtatctgagacaggccgtgagcctgctggcagcagataagctggccttcgactacggcgccctgctggacgatctggcacactggctggacccctatctgccagtggcaaggggcgacgcaatcaggcagcggtgggccagagacttctacgccgccctggccaacaccacagatacctctctgcacaaggactaa

SEQ ID NO: 173 - DNA, 1143 bp, Pseudomonas aeruginosa DHS01
  misc_feature (1)..(1143): Cas7
atgaacctgtttatcgagttccacctgatccagaattttgccccatccaacctgaatagggacgataccggagcaccaaaggacgcaatctttggaggacacaggagagccagagtgagctcccagtgcttcaagagagccatcaggctgaccgcccacgagcaggagctggtggcccccgagcacaggggcgtgcggacaaagaagctgaaggccctgctgctggagaggctggcaggacgcgatcctgcagaggcagagggcaagatcgagaccgccctggcagcagcaggcctgaagctgaaggacgatggcaagacagagtacctgctgtttctgggagaggcagagatcgcaggattcgccgccctgatcgagcagcggtgggacgagctgggcagcgccgcaccagccggcgagaagaagggcaagaaggaggccaaggccaacgtgcccaccgaagtgatcaagcaggcaagggccctgctggatggaggcaaggcagtggacgtggccctgttcggaaggatgctggccgatctgccagaggtcaatcaggacgcagcatgtcaggtggcacacgcaatctccacccacagggtggagagggagtttgactacttcacagcagtggacgataggggaggccccgatgagtctggcgcaggaatgatcggccaggtggagtttaacagcgccaccctgtacagatatgcagtggtggacctgcgcaagctgctgggaaacctgcagaatgatggagagctggtgctgtccgccctggaggccttcacccaggcaatggtgcgcgcaatcccatctggcaagcagaacacatttgccgcccacaatctgcctgccttcgtgggaatctgcctgaggcacgcaggaccactgaacctggccaatgcctttgagaagccagtggtggcaagggcagacgcctccctgtctgagcggagcgtggcagagctggcaagacacgatcagcagctggcaagcgtgtacggcgacagccgggatagatgggcctatctggacatctccggcgcatggccaaaggagagaggagagccagcaggaaacctgcagcagctggccgattggctgaggtctcaggtgtctagccgcctgggaggataa

SEQ ID NO: 174 - DNA, 663 bp, Pseudomonas aeruginosa DHS01
  misc_feature (1)..(663): Cas5
atggccaccctgctgatgaggctgcagggaccaatgcagtcctggggaaccacatctcggttcgacgagagagatacacagctggagccttctaagagcggcgtgctgggactggtgtgcgccgccctgggaagggatagaagcgagccactggaggacctggcctccctgcggatgggcgtgcgcgtggatagggagggcatccccctgagagactatcagaccgcaacaggcgtgctggtggcatccggcaaggccgatcccaggagaaccgtggtgtctcctcggcactacctggccgacgccgtgtttctggtgggcctggagggcagagatcaggccctgctggagagaatccagcaggccctgagagcaccattttggcctctgtgcctgggaaggaagagcttcgtgccaggctcccccgtgtggctgcctgagggactgtcctctctggccctggagcaggccctgcaggcctggccaagactggcagaggcacagcctggcgacaggggcaagccactgagatgtctgatcgaggacgagaggagcggcgtggtgcgcctggatcagcctatcgcaccattcgccgagaggcgctttggaccaagattcgtgaggtccggcgtggcagacgtgcccgatcagaccgacccttaa

SEQ ID NO: 175 - DNA, 612 bp, Pseudomonas aeruginosa DHS01
  misc_feature (1)..(612): Cas6
atgtatctgaccaggctgaccctggacccccgcagcgcccaggcacggagagatctgggcgacgcctacgagatgcacaggaccctgagccgcgtgtttgcagacgagcaggcaccagcatcccggttcctgtggagactggaggcctctggcaacgcctggagcacccctacactgctggtgcaggcagcatccgagggaaattggtctgtgctgcaggccctgccaggatacctgctgggagagccacagtccaagtctctggccctgaggcagtggctggagtctgacatcagctacaggtttcgcctgttcgccaatcccaccgtgacaaggcagggcaagcggtacggactggtgggagaggagcagcagctggcatggctggcaaggcagggcgagagacacggctttgtggtggaggccgccctggtgaccttcagcgaggtgctgggctcccggaagagacagacacggatctccgtgctgagagccgcctttgagggcaggctgcgcatctctcgcccagatgccttcggccaggccctggtggcaggaatcggacccgccaaggccttcggctgcggcctgctgtccctggcaaggagctaa

SEQ ID NO: 176 - protein, 522 aa, Pseudomonas aeruginosa DHS01
  misc_feature (1)..(522): Cas8
MTEHYNLLDTPWLPVRLANGEVREMGLLEVYREAERISALAETEPPSLIAQYRLLLAITHRALLLEYGAWKDSGRLRWFREGLPIDVVERYLERWRERFWLFHPQYPFMQVAALASAAETCDKQKPWAQISLASANGNTPVVFDHSYDLAPSAVSADRALCALLGFLQFTPGGLVKTVRDSDKAGALANTAAVVPLADSLAKTLCLALHPASGEAAFDLPAWEREALTIPQLAADPILASGPNDRYTRQSRAVLLLPEEEGCVRWIRFAAGQALADDVQAPDPMASYRPGANNSMVRLSFGEGRVFWRDLPSLLPDSAAAGSKRAAVLDWASNLRSIGADAPSSMLLVAGLASDQAKLLRWRSETVVLPAALLDSEGCANELRRCIRESEDLYGELRKIAVAMLAEALPDPASKDTWARARTSFDNGPAAATYFALLERSLPSLMALIGGDRLEMLDEAEAFWRSRLLAALEVAWQGVREGLGLSVAALRAEAKVRPRYLALLRRYRSERTSSTPLAEEQCA

SEQ ID NO: 177 - protein, 176 aa, Pseudomonas aeruginosa DHS01
  misc_feature (1)..(176): Cse2
MSAAEHPFIGHLQRLQNDRGALAVLRRSLGFAPGAYVPAYPYVERFVGAERHAQDAWRLALYLTAGLFASHPGQGRASLAMRFGELMKARNSASIEKRFIALLAADAENLPVYLRQAVSLLAADKLAFDYGALLDDLAHWLDPYLPVARGDAIRQRWARDFYAALANTTDTSLHKD

SEQ ID NO: 178 - protein, 380 aa, Pseudomonas aeruginosa DHS01
  misc_feature (1)..(380): Cas7
MNLFIEFHLIQNFAPSNLNRDDTGAPKDAIFGGHRRARVSSQCFKRAIRLTAHEQELVAPEHRGVRTKKLKALLLERLAGRDPAEAEGKIETALAAAGLKLKDDGKTEYLLFLGEAEIAGFAALIEQRWDELGSAAPAGEKKGKKEAKANVPTEVIKQARALLDGGKAVDVALFGRMLADLPEVNQDAACQVAHAISTHRVEREFDYFTAVDDRGGPDESGAGMIGQVEFNSATLYRYAVVDLRKLLGNLQNDGELVLSALEAFTQAMVRAIPSGKQNTFAAHNLPAFVGICLRHAGPLNLANAFEKPVVARADASLSERSVAELARHDQQLASVYGDSRDRWAYLDISGAWPKERGEPAGNLQQLADWLRSQVSSRLGG

SEQ ID NO: 179 - protein, 220 aa, Pseudomonas aeruginosa DHS01
  misc_feature (1)..(220): Cas5
MATLLMRLQGPMQSWGTTSRFDERDTQLEPSKSGVLGLVCAALGRDRSEPLEDLASLRMGVRVDREGIPLRDYQTATGVLVASGKADPRRTVVSPRHYLADAVFLVGLEGRDQALLERIQQALRAPFWPLCLGRKSFVPGSPVWLPEGLSSLALEQALQAWPRLAEAQPGDRGKPLRCLIEDERSGVVRLDQPIAPFAERRFGPRFVRSGVADVPDQTDP

SEQ ID NO: 180 - protein, 203 aa, Pseudomonas aeruginosa DHS01
  misc_feature (1)..(203): Cas6
MYLTRLTLDPRSAQARRDLGDAYEMHRTLSRVFADEQAPASRFLWRLEASGNAWSTPTLLVQAASEGNWSVLQALPGYLLGEPQSKSLALRQWLESDISYRFRLFANPTVTRQGKRYGLVGEEQQLAWLARQGERHGFVVEAALVTFSEVLGSRKRQTRISVLRAAFEGRLRISRPDAFGQALVAGIGPAKAFGCGLLSLARS

SEQ ID NO: 181 - DNA, 91 bp, Pseudomonas aeruginosa DHS01
  misc_feature (1)..(91): CRISPR
gtgttccccacatgcgtggggatgaaccgggcaccatcggcgccattgaccgcgcgctgaaggtgttccccacatgcgtggggatgaaccg

SEQ ID NO: 182 - DNA, 1668 bp, Streptococcus thermophilus strain ND07
  misc_feature (1)..(1668): Cas8
atgagtcggtttaatttacttgatgaaccctggatttctgttatttatgacgagaaaggatccacaaaagatgtttctttacaggatttatttacaaatgctcatcagtataaagaattagcaggagatacgaaaacacaagattttgcggtattacgagtattgttggctgttttgcatacagttttttcccgatttgatatagatggaaatgcttatgagtatcttactattgatgaaggatggaatcagcttgaaccagtggatgagatggatattgagaattatgaagaagctctttatgaaacatgggaaaaactttggactaataaaagatttccaaatattgttaatcaatacttagaaaaatggcgagatcgcttttacttatttgaccaaaagtatccattttttcaggtaacgaaagaagatattgctggagataaaattagcaaagccaaaggaactagtattttgggtaaaaatataaatagaattatatctgagagtggaaataagatagctttattttccccaaaagatgaagaaaataaaaatactctaactgccgcagaattagctagatggctaattacatttcaagggtattcaggagtatccgataaggtcatttttggaaatgaaaaatatacaccttcgaaaggatggctatttgatattggtgctatttatattaaaggtaacactttattcgaaacgttgttactaaattatatttcaccgtataatgaatgtggtaatgtagaaaatattcagcgaccttgctgggaacgtaaaagttctgatatcattaaaagttaccttgatgaaaaagatattaccaatatagctagtttatatactgtttggagtaaaggaatctatattgacccagactttaatttaaataaacctttctcttttgatattgtgaaattacctgatatcaatcatagggataattttttggagccaatgacactttggaagtataatgtttcgggtaaaaatagggatagctatacaccaaagaaacatcttttgaatcagtctttatggcgatcttttggcttgttatctataaaagatactgatcttcaacatagaaaacctggcgttatcgaatggcttacatatattgatgatataataggaaatcgactatcaaacattgttgcaattagtatgcaggacgatggaaaccctcaatcacggcttccaacggatgaggttattgactcaatttttatcaatgatttggttttaacggatttagacgagggtggttgggttcctcgtatcaatgaagtagtagaagaaacaaaaaaaattatttctagaacatataaaacgtatattaatgatataaaggaaatcagaaatatctctaatggtagttatactcagcagatagttgaaagtctatatttcaaaatcgatcaacctttccgacaatggttagctagcattcaaccagaagatgataaagattctaagatacaagaatggagagttttactgaagaaaatagttaaagctgaagcagaagttattttacatcaagggggggcgagggattatcttggtatccaaaaagatgggcgaattaagaatattgcaactgcctataattcgttcgatttttggcttcgtcaacagttaaaatag

SEQ ID NO: 183 - DNA, 594 bp, Streptococcus thermophilus strain ND07
  misc_feature (1)..(594): Cse2
atgtcacaacatactaaacaaacagtttggactgttacaaagaagattattttcaaattgagtaaccaaaaagaggaaacatatgataaagctacactagcaaaagttagaaaaacattggggaaacccttgagtgaagcaacagaaatatggccaattctgttcgaaaatttaccagaggaatttttaagttcgtatcagcaaccaagctatgaggaattagctatttatacagcgcttcaattgtatgcattgcatcagcaaggtgtttcaacaagtgtgatgctagatgattctaagccctatgaaaatataggttctgcacttggtaagcttaggaaagaagatgataccacttcaattgatagacgattcaataccatgattacctcatcaacgtttgaagaacttacttatcatttaaggcatttgatttcgctacttaaagtggagtcaccggtgattcaggttgattactctggcctagcaaatgatttatattggtttttaaataatagtcaagaaaatgtccgcctaaattgggcaagagcatattataaacaaattaaaggagaaaaaaacaatgacaactga

SEQ ID NO: 184 - DNA, 1068 bp, Streptococcus thermophilus strain ND07
  misc_feature (1)..(1068): Cas7
atgacaactgaacaacgattatttttagatattcatgctattcaaagcttaccaccttcaaatatgaatagagatgatacaggtagcccgaaaacagctcagtatggaggagttagaagatctcgcgtaagttctcaagcatggaagaaagcgatgagagagtattttaatactcatggtgatcattcaaatgttggtattagaacaaaagaaattgtgagatatgttgcagataaaatagtagaactagatagttctatcagtattgaagatgctttggaaaaagccgataaagtcttgatagctgctggaatcaagaaaaaaggtgaagttaaagcactttattttatgggtgatagtcaagctaagaagttagctcaagcagcctatgacaatataacacataaaaaagagcttcaaaagttggctaatgaagatccagctattgatattgccctgtttggtcgaatggtagccgaagatccaactcttaacgaggattcttcttctcaggttgcacatgccatttccacacatccagtacaaactgaatttgatttctttacggctgttgatgatttagctccagaggataatgcaggggcgggtatgcttggaactgttgagtttaattcttctacactatatcgctatgcaaatgttgcgattcatgaattgtcaaaacaattaggaaacaaggaatcgttggagaatagtttatctttgttcattgaggcttttgcaaagtcacttccaacagggaaagtaaatacatttgctaatcaaacgctaccacagactttaattgtaacggttcgaagtgatcgtccggttaatcttgtcagtgcatttgaagaaccagttaaatcaatagaaggctatgttactaaatctatcgataaactcgccaaagagtttattaaggttgagaaatttgtagacaaaccacttatgaccttctatgttactttgcatgagagcgacagtctaaaacaaattggggaggaaaaagattcagtttcaaaattattggaagatttttcagaaatgatagcccaatatatttaa

SEQ ID NO: 185 - DNA, 726 bp, Streptococcus thermophilus strain ND07
  misc_feature (1)..(726): Cas5
atgaagacgatattgttgaaatttgctggccccttacaatcatggggaacgagttcacattttgaaactaggcatacagatttttatccttccaaaagtgcggtaattggactacttgctgctagtttaggttataggagagacgaagatgaaaaaattcaaaaattaaatgaacttgattttgctgttcgtgtcgatcagcaaggaaatctgttaagagacttccatgttgcacagaagtatacagaaaagggtaaatttgatagaaattatgttacgaatcggtattatctagaagacgctgtatttgttgtagccctctcccatacagatgatagctttatagatatcattaaaggtgctctaaaaaatccctatttccaaccttttatggggagaagggcactcccaataactgcagactttatcttaggtgagacagatgttaatccattagagagcctaaaatcgctgaaatggcaagcttctctatggtttatgaaaaaatctcatgataaggatgctatttctttggaagtttatctagatagtcaattagtcaacaaggatgtttatcagctgaggcaagattatgttaggtcattttcacaaaaagggagaagatttggttttaggtatgaagtacgtgaattaatcagtgttcaaaatcctcactatttaaataagaatacagagcataacattttcgagagtataggagattga

SEQ ID NO: 186 - DNA, 639 bp, Streptococcus thermophilus strain ND07
  misc_feature (1)..(639): Cas6
atgtacatttctagggtagaaattgatcgatataatagacgaaaggttagagatttaacgcatgtaggagcttatcatgcttgggtggaagagagttttccatcggaattagagcaatcaatccgtacaagaaaattatggcgaatcgatcgtattcaaggtaaggattatcttattattgtaagtaaagaaaaacctaatttacaaaaacttgaaaaatatggtgttgtaggaagcgctcaaactaaggactatcaacattttttagatagcatcaaaactggttttcgaatgaattttagaatagtgctaaatccggttatttcaattacttcacccgataaatcaaaacgaggagttgtaaaaccgcatgtgacgattaaacatcagatggactttctagtgaaacaatctgagaaaaatggcttctcattagtaggagaaagtttctcaattgttgaacgtggttatgaagtttttcagaaaccagaaaaacccatacgactatcaaaagttgtttacgaaggaaccttaactgttagtgatgatacgcttttcaaaaaaatgctgaccgagggagttggaaagaaaaaagcatatggttttggcttgatgacagtggtaccacttgaggaatga

SEQ ID NO: 187 - DNA, 1668 bp, Streptococcus thermophilus strain ND07
  misc_feature (1)..(1668): Cas8
atgtccaggttcaacctgctggatgagccatggatctccgtgatctatgacgagaagggcagcaccaaggacgtgtccctgcaggatctgtttacaaatgcccaccagtacaaggagctggccggcgacaccaagacacaggatttcgccgtgctgcgggtgctgctggccgtgctgcacaccgtgtttagcagattcgacatcgatggcaacgcctacgagtatctgacaatcgacgagggctggaatcagctggagcctgtggacgagatggatatcgagaactacgaggaggccctgtatgagacctgggagaagctgtggacaaataagcggttcccaaacatcgtgaatcagtacctggagaagtggcgggaccggttctacctgttcgatcagaagtatcccttctttcaggtgaccaaggaggacatcgccggcgataagatcagcaaggccaagggcacatccatcctgggcaagaacatcaatagaatcatctctgagagcggcaacaagatcgccctgttctccccaaaggacgaggagaacaagaataccctgacagcagcagagctggcaaggtggctgatcacctttcagggctactctggcgtgagcgacaaagtgatcttcggcaacgagaagtatacacccagcaagggctggctgtttgatatcggcgccatctacatcaagggcaataccctgttcgagacactgctgctgaactacatctccccatataatgagtgcggcaacgtggagaatatccagcggccctgttgggagagaaagagctccgatatcatcaagtcttacctggacgagaaggatatcaccaatatcgcctctctgtacacagtgtggagcaagggcatctatatcgaccccgacttcaacctgaataagcccttttccttcgacatcgtgaagctgccagacatcaaccacagggataatttcctggagcccatgaccctgtggaagtacaacgtgtccggcaagaatcgcgattcttatacacccaagaagcacctgctgaaccagtctctgtggaggagctttggcctgctgagcatcaaggacaccgatctgcagcaccgcaagcctggcgtgatcgagtggctgacatacatcgacgatatcatcggcaaccggctgagcaatatcgtggccatctccatgcaggacgatggcaatccacagagcagactgcccaccgacgaagtgatcgattccatcttcatcaacgacctggtgctgacagacctggatgagggcggctgggtgcccagaatcaatgaggtggtggaggagaccaagaagatcatctcccggacatacaagacctatatcaacgatatcaaggagatcagaaacatctccaatggctcttacacccagcagatcgtggagagcctgtacttcaagatcgaccagcccttcagacagtggctggcctccatccagcctgaggacgataaggattctaagatccaggagtggagggtgctgctgaagaagatcgtgaaggccgaggcagaagtgatcctgcaccagggaggagccagggattatctgggcatccagaaggacggccgcatcaagaacatcgccaccgcctacaatagctttgacttctggctgaggcagcagctgaagtaa

SEQ ID NO: 188 - DNA, 594 bp, Streptococcus thermophilus strain ND07
  misc_feature (1)..(594): Cse2
atgtctcagcacaccaagcagacagtgtggaccgtgacaaagaagatcatcttcaagctgtccaatcagaaggaggagacctacgataaggccacactggccaaggtgcgcaagaccctgggcaagcctctgtctgaggccacagagatctggcctatcctgtttgagaacctgccagaggagttcctgagctcctaccagcagccatcctatgaggagctggccatctacaccgccctgcagctgtatgccctgcaccagcagggcgtgtctacaagcgtgatgctggacgattctaagccttatgagaacatcggcagcgccctgggcaagctgcgcaaggaggacgataccacaagcatcgacaggcgctttaataccatgatcacatctagcaccttcgaggagctgacctaccacctgcggcacctgatctccctgctgaaggtggagtctccagtgatccaggtggactactccggcctggccaacgatctgtattggttcctgaacaattctcaggagaacgtgaggctgaattgggcccgcgcctactataagcagatcaagggcgagaagaacaatgacaactaa

SEQ ID NO: 189 - DNA, 1068 bp, Streptococcus thermophilus strain ND07
  misc_feature (1)..(1068): Cas7
atgaccacagagcagagactgtttctggacatccacgccatccagagcctgcccccttccaacatgaatcgggacgataccggctcccctaagacagcccagtatggcggcgtgcggagatctagggtgagctcccaggcctggaagaaggccatgcgcgagtacttcaacacccacggcgatcacagcaatgtgggcatcaggacaaaggagatcgtgcgctatgtggccgacaagatcgtggagctggattctagcatctccatcgaggacgccctggagaaggccgataaggtgctgatcgccgccggcatcaagaagaagggcgaggtgaaggccctgtacttcatgggcgattcccaggccaagaagctggcacaggcagcatacgacaacatcacccacaagaaggagctgcagaagctggccaatgaggaccccgccatcgatatcgccctgttcggaaggatggtggcagaggaccctaccctgaacgaggattcctctagccaggtggcacacgcaatcagcacccacccagtgcagacagagtttgatttctttaccgcagtggacgatctggcccccgaggacaatgcaggagcaggaatgctgggaaccgtggagttcaactcctctacactgtaccggtatgccaatgtggccatccacgagctgtctaagcagctgggcaacaaggagagcctggagaattctctgagcctgtttatcgaggccttcgccaagtccctgcctaccggcaaggtgaacacatttgccaatcagacactgccacagaccctgatcgtgacagtgaggtccgaccgcccagtgaacctggtgtctgccttcgaggagcccgtgaagagcatcgagggctatgtgaccaagtccatcgataagctggccaaggagtttatcaaggtggagaagttcgtggacaagcccctgatgaccttttacgtgacactgcacgagtccgattctctgaagcagatcggcgaggagaaggatagcgtgtccaagctgctggaggacttcagcgagatgatcgcacagtacatctaa

SEQ ID NO: 190 - DNA, 726 bp, Streptococcus thermophilus strain ND07
  misc_feature (1)..(726): Cas5
atgaagaccatcctgctgaagtttgcaggacctctgcagtcctggggcacatcctctcactttgagacaagacacaccgacttctatccatccaagtctgccgtgatcggactgctggcagccagcctgggataccggagagacgaggatgagaagatccagaagctgaatgagctggacttcgccgtgcgggtggatcagcagggcaacctgctgagagactttcacgtggcccagaagtacaccgagaagggcaagttcgatcggaactatgtgacaaatagatactatctggaggacgccgtgtttgtggtggccctgtcccacaccgacgattctttcatcgatatcatcaagggcgccctgaagaacccctactttcagcctttcatgggcaggcgcgccctgcctatcaccgcagactttatcctgggcgagacagatgtgaatccactggagagcctgaagtccctgaagtggcaggcctctctgtggttcatgaagaagagccacgacaaggatgccatctccctggaggtgtacctggactctcagctggtgaacaaggacgtgtaccagctgcggcaggactacgtgcggagcttcagccagaagggccggagattcggctttaggtacgaggtgcgcgagctgatctccgtgcagaaccctcactatctgaacaagaataccgagcacaatatcttcgagagcatcggcgactaa

SEQ ID NO: 191 - DNA, 639 bp, Streptococcus thermophilus strain ND07
  misc_feature (1)..(639): Cas6
atgtacatcagcagggtggagatcgatcgctataataggaggaaggtgcgcgacctgacccacgtgggagcatatcacgcctgggtggaggagtcttttccaagcgagctggagcagtctatcaggacacgcaagctgtggcggatcgacagaatccagggcaaggattacctgatcatcgtgagcaaggagaagcccaatctgcagaagctggagaagtacggagtggtgggcagcgcccagactaaggactatcagcacttcctggattccatcaagacaggctttcggatgaacttcagaatcgtgctgaatcccgtgatctccatcacctctcctgacaagagcaagcggggcgtggtgaagccccacgtgacaatcaagcaccagatggattttctggtgaagcagtctgagaagaacggctttagcctggtgggcgagtctttcagcatcgtggagaggggctatgaggtgttccagaagcctgagaagccaatccgcctgtctaaggtggtgtacgagggcaccctgacagtgagcgacgataccctgtttaagaagatgctgacagagggcgtgggcaagaagaaggcctacggcttcggcctgatgaccgtggtgcccctggaggagtaa

SEQ ID NO: 192 - protein, 555 aa, Streptococcus thermophilus strain ND07
  misc_feature (1)..(555): Cas8
MSRFNLLDEPWISVIYDEKGSTKDVSLQDLFTNAHQYKELAGDTKTQDFAVLRVLLAVLHTVFSRFDIDGNAYEYLTIDEGWNQLEPVDEMDIENYEEALYETWEKLWTNKRFPNIVNQYLEKWRDRFYLFDQKYPFFQVTKEDIAGDKISKAKGTSILGKNINRIISESGNKIALFSPKDEENKNTLTAAELARWLITFQGYSGVSDKVIFGNEKYTPSKGWLFDIGAIYIKGNTLFETLLLNYISPYNECGNVENIQRPCWERKSSDIIKSYLDEKDITNIASLYTVWSKGIYIDPDFNLNKPFSFDIVKLPDINHRDNFLEPMTLWKYNVSGKNRDSYTPKKHLLNQSLWRSFGLLSIKDTDLQHRKPGVIEWLTYIDDIIGNRLSNIVAISMQDDGNPQSRLPTDEVIDSIFINDLVLTDLDEGGWVPRINEVVEETKKIISRTYKTYINDIKEIRNISNGSYTQQIVESLYFKIDQPFRQWLASIQPEDDKDSKIQEWRVLLKKIVKAEAEVILHQGGARDYLGIQKDGRIKNIATAYNSFDFWLRQQLK

SEQ ID NO: 193 - protein, 197 aa, Streptococcus thermophilus strain ND07
  misc_feature (1)..(197): Cse2
MSQHTKQTVWTVTKKIIFKLSNQKEETYDKATLAKVRKTLGKPLSEATEIWPILFENLPEEFLSSYQQPSYEELAIYTALQLYALHQQGVSTSVMLDDSKPYENIGSALGKLRKEDDTTSIDRRFNTMITSSTFEELTYHLRHLISLLKVESPVIQVDYSGLANDLYWFLNNSQENVRLNWARAYYKQIKGEKNNDN

SEQ ID NO: 194 - protein, 355 aa, Streptococcus thermophilus strain ND07
  misc_feature (1)..(355): Cas7
MTTEQRLFLDIHAIQSLPPSNMNRDDTGSPKTAQYGGVRRSRVSSQAWKKAMREYFNTHGDHSNVGIRTKEIVRYVADKIVELDSSISIEDALEKADKVLIAAGIKKKGEVKALYFMGDSQAKKLAQAAYDNITHKKELQKLANEDPAIDIALFGRMVAEDPTLNEDSSSQVAHAISTHPVQTEFDFFTAVDDLAPEDNAGAGMLGTVEFNSSTLYRYANVAIHELSKQLGNKESLENSLSLFIEAFAKSLPTGKVNTFANQTLPQTLIVTVRSDRPVNLVSAFEEPVKSIEGYVTKSIDKLAKEFIKVEKFVDKPLMTFYVTLHESDSLKQIGEEKDSVSKLLEDFSEMIAQYI

SEQ ID NO: 195 - protein, 241 aa, Streptococcus thermophilus strain ND07
  misc_feature (1)..(241): Cas5
MKTILLKFAGPLQSWGTSSHFETRHTDFYPSKSAVIGLLAASLGYRRDEDEKIQKLNELDFAVRVDQQGNLLRDFHVAQKYTEKGKFDRNYVTNRYYLEDAVFVVALSHTDDSFIDIIKGALKNPYFQPFMGRRALPITADFILGETDVNPLESLKSLKWQASLWFMKKSHDKDAISLEVYLDSQLVNKDVYQLRQDYVRSFSQKGRRFGFRYEVRELISVQNPHYLNKNTEHNIFESIGD

SEQ ID NO: 196 - protein, 212 aa, Streptococcus thermophilus strain ND07
  misc_feature (1)..(212): Cas6
MYISRVEIDRYNRRKVRDLTHVGAYHAWVEESFPSELEQSIRTRKLWRIDRIQGKDYLIIVSKEKPNLQKLEKYGVVGSAQTKDYQHFLDSIKTGFRMNFRIVLNPVISITSPDKSKRGVVKPHVTIKHQMDFLVKQSEKNGFSLVGESFSIVERGYEVFQKPEKPIRLSKVVYEGTLTVSDDTLFKKMLTEGVGKKKAYGFGLMTVVPLEE

SEQ ID NO: 197 - DNA, 89 bp, Streptococcus thermophilus strain ND07
  misc_feature (1)..(89): CRISPR
gtttttcccgcacacgcgggggtgatcctatacctatatcaatggcctcccacgcataagcgtttttcccgcacacgcgggggtgatcc

SEQ ID NO: 198 - DNA, 1743 bp, Streptomyces sp. S4
  misc_feature (1)..(1743): Cas8
ttgcccgggaagggtggggcgtcggtgaatctgttatctgatgggtggctttcagctgtttccgcaggtgggggctctggtttcgggggtggtcctggggcggggccggcggagttcggtgtgcgggagcttctgctgaatgcggagaagttcgctgacatcgtggtggacctgcccacgcagcgtccggcggtgttccggcaggtcctgctgccgttggtggtggacgcgttggggtgtccgaaggacgccgaggcgtggatggacatgttccgggcgggggctttcagccctgagcagcggcaggtgctggctgattacctggacaagcaccagcatttgttcggtcttctggatccggtggagccgttcggtcaggtggctgacctgcggacggcgaagggggagaccaaggggtcggcgttgctggtggcgacggcggccaccgggaacaacgtgccgttgttctcgtcccggacggagggcgacgtactggagctgacgcccgctgaggcggccaggtggctgctgcacacccactgctgggacacggctgccatcaagaccggcgcggtcggtgacccgatggtgaagtccgggaagacgaccggcaatccgacgggcccgctgggtcagctcggcgtgaccatgccggtggggtcgacgcttttcgagacgttgttgctcaacatcccgtacggccaggctgggctgtccgacgacgtgccgcagtggcgacggcgtagtacgcagggcgacgtcaaggacactctctcgtgtgcgacgcctgtgtggcagagcagaccggcgcgggggctgctggaggcgtggacgtggcaggctcgccggatccgtctcatctctcaggacaccgaccgggggccgcgcatcacccgggtgctggtcgcggccggcgaccgtcttgaggtcagcccggacacggaaccgcacacggcctgggtggtggacagccccgccggccggcggggtaagagtcccgcgcggtctggggtgaagagtgcgcgtccgcgccgtcacacggcaggccgcgccgggtggcgtggtcttgacgcgctgctggccgtgaacgctgtcgaccaggaccagcaggcgaccgccacccgcagcggggcggtgagcagccagctggtgcggcagctcagcgccatcagccgccgcttgcccagccggtatccgctgcgggtcgagctgaccgggatcgcctacggcaaccagtcggccgtcatcgaggacatgtacttcgacgagatcccgctgcccgtggccgctctcgacccggaggggatcgtctacggggcgctgctggaggtggtcgaccaggcggaggacctggccaaggcggtcaatcacctgtcgggggaccttcgccgggccgcgggcagtgaaccgatcccgtgggacaagggccagcgtcccggagacaccctgttgcacgctctcgacccgatcgtgcggcgtctgttggccggcctgcgccaggccggcgacgacttcgaccggtgtgagcagggactggaggcgtgggagcacaaggccgggcaggccacgctccgcgtcgcggagggcctgttcaattcggcgcccgccgccctgttcaccggccgccgcgtcaagaaggacggcaaggagcaggtctaccgtctcagcactgccgaagcgtccttccgccggcggctcgccgtgatcctccaccgccgcgccgctgcacgtactgccggctga

SEQ ID NO: 199 - DNA, 615 bp, Streptomyces sp. S4
  misc_feature (1)..(615): Cse2
gtgtccacctcacccttgtccgctcccgtccccggccagagagtttcctccctgcccaggccctactggagcggccgtgcggacgagcaaggccagtggcggacacgcgccggggaatccctgcgaccgcccggggaggacctcagcgcgctgagagccggcctgggaaagaaggcgttcaccgaaccccgcctgtggcagtactacacgacacccaccgacggccgcgtcaccctcgagctggaggccgagcacgccgcgctcgccctgtacgggctgcatcagcaaagccaggagcagccgatgcaccggcagggtgtccgcaccggcagggccctgcgcgccctgcaccagcggtacagcgaagaggcgaccgaccggcgggtggcgcaggccgtcggtgcgacctcggctgcggccttcgcctaccggctccgcgcactggtgacgcagttgcgttccatcgggcagcccctggactacgaccagctgatgcaggacctcctgcgctggcacttccccgacggacgctcccgggtccgccgcgggtggggtcttggctaccacggccgcgatcgccagcccgacgaagccccgccccccgaaggctcgtag

SEQ ID NO: 200 - DNA, 1167 bp, Streptomyces sp. S4
  misc_feature (1)..(1167): Cas7
atgtctcagcccgccgcccgcccgccgcgcacgtacgtcgacttccacatcctgcagacggtccccccggccaacctcaacagggacgaccagggcaaccccaaggaggcctactacggcggtgtccgccgctctcgtgtttcctcccaggcgtggaagcgtgccacccgcacccacttcgccgagcgggtccccgagcaggacctcgccacccgcacccgcaggatcatcggcgccctcgccgatgacatccagaagcgcgccggcctggaccgcccggcagcgctgcgcctggccgacgcgctgctggcgccgttggagctgagcggcggcaagaagaaggacgagtcggcctacctcctcttctacggccggcgccagctcgatgccgtagccgccctcgtcgccgaccaggcaaccgaactgtccgcgctgagcgacgccgacctcgcttcccgggtgaaggagctcccggttcgtgagcagttcagcacgggccacccgatcgatgtcgcccttttcgggcgcatggtcgcggacatccccgctctcaaggtcgacgccgcggcgcaggtcgcccatgccctgtccacccacgcggtggagctcgagttcgactacttcacggccgtcgacgatgagcagaccgacgaggagaccggtgccggcatgatcggcaccatcggcttcaactccgccaccctctaccgctacgcctccgtcggcctccaccagctcctggacaatctcaccgacgaggaagcggccctcaccgccatcagcgagttcgccacgtccttcgcgcgctccatgcccaccggctaccagaactcctttgcccaccgcaccctgcccagcctcgtcgccgtcgtcgtccgcgaagaccagcccgtcaacctcgtctccgcgttcgaacaaccggtggccaccccctcgggcatcgccgccgcctccgccgcgcggctcgccgaggaacacacacgcgccaccgtcacatggggcgacgctccggccttcgcagccgccacccacgtgttcaccgaccaccagaagaccaccgccgccctcaacagcgcgttcggcccctccatccccttctccgctctcctcgaaggcctgcacacccacctggccggagccctcaagcccaagcaggccgcgcagtga

SEQ ID NO: 201 - DNA, 882 bp, Streptomyces sp. S4
  misc_feature (1)..(882): Cas5
gtgaccaccgcccccacccccgagcccgccggcaacacgcacccggcccacggcagcgacgaaccgaccgtgctgctgcttcgcctcgccggccctctgcagtcctggggcgtacgcagttccttcaaccgccgcgacaccggcgcggaacccaccaagtccggcgtcatcggcctgctggcggcagcggcaggacacccccgtgaacaacccctgggagagctcgcggacctgaccctcggtattcgcgtcgaccaaccaggcaccctgctgcgcgactaccacaccgtcagcgactaccgaggccgccccctgccgcaggcaggtgtctccgcgaaaggcatccagaagcccacctcaccggccaaacacacccacgtcaccacccgcttctacctccaggacgcggtattcgtcgccgccctcgaaggcccccccggcctcctcaccaccctggacagggcggtacgcaaccccgccttcccgctcgcactgggacgccgctcctgcccaccgacccaacccctcagcctcggcttgcgcaccaccgacatggaaaccgccctgcgcagcgagccctggcaggcctccgcccacacccgcgagcagtacgcccgccgcctgggccgagaacgcggcctccaccagcctcttcacccaggcaccatcgatcgcgcagccaccatcgaagacccccgcggcgacgaccgcctgcaggacgcacccgtctccttcgacccccaccagcgcgccttcaccagccgccaagtccgccacacctggctggccatccccaccggcttcgaccacatcgacgacgaccagccccacggccaggccgacgaccccgaccacgaccctttcgccctgctgggctggtga

SEQ ID NO: 202 - DNA, 813 bp, Streptomyces sp. S4
  misc_feature (1)..(813): Cas6
atgacctacctctcccgcatccgcatcaatcccctccgcaaggacagcaggaaactgctctccaacccccgtgccgtacacggcgccgtcatgggcggcctgcccaaccacaagcccgacgaccgcgtcctgtggcggatggaccccgacaacccccaccggccccacctcttcgtcctcagcccgacacgccctgactggacgcacatcatccaggactgcggatggccggacgcggacggtgaccatgccgccgtccgcgactacacccccctcctcagtcagctggccgtcggccgcgaattcgccttccgcctcaccgccagccccgtccagaacaccgccacccccacgaaggcgacacccgcccaggccgcccgcctgaccacccacgccgaaaacggcaaacgcatccgcggcttccgcatgggccaccgcacagcagccgcccaactcgactggttcctcacccggaccgaccgctggggcttcgacatccccgccacccgctccgatcccgccgcccccggcatccacgcccccacaccccccaccgcccctcgccccacctcgccaccccgcccagaccccaaccctccctacgaagtccgcatcaccgcccgccaccgccattccttccagaagaacggacacggagcgcacgtcgtcttccgcagcgcaaccttcgaaggccgcctgcgcatcaccgacaccgaccgcttcaccaccagcctcctcaccggcctcggcccctcccgcgcctacggctgcggcctgctcaccctcgccccgctgcccggacagcagacctga

SEQ ID NO: 203 - DNA, 1743 bp, Streptomyces sp. S4
  misc_feature (1)..(1743): Cas8
atgcctggcaagggaggagcaagcgtgaacctgctgtccgatggctggctgagcgccgtgtccgccggcggcggcagcggctttggaggaggacctggagcaggaccagcagagttcggcgtgcgcgagctgctgctgaatgccgagaagtttgccgacatcgtggtggatctgccaacccagaggcctgccgtgttccggcaggtgctgctgcctctggtggtggacgccctgggatgtccaaaggacgcagaggcctggatggatatgtttagggcaggagccttctcccccgagcagaggcaggtgctggccgactacctggataagcaccagcacctgtttggactgctggaccccgtggagccattcggccaggtggccgacctgagaacagcaaagggagagaccaagggcagcgccctgctggtggcaacagcagccaccggcaacaatgtgcccctgtttagctcccggacagagggcgacgtgctggagctgacccctgcagaggcagcaagatggctgctgcacacacactgctgggataccgcagccatcaagacaggagcagtgggcgaccctatggtgaagagcggcaagaccaccggaaacccaacaggacctctgggacagctgggagtgaccatgccagtgggctccacactgttcgagaccctgctgctgaatatcccatacggacaggcaggactgtctgatgacgtgccacagtggaggcgccggagcacccagggcgacgtgaaggataccctgtcctgtgcaacacccgtgtggcagagccggccagcaaggggactgctggaggcctggacatggcaggccagaaggatcagactgatctcccaggacacagatcgcggcccaaggatcaccagagtgctggtggcagcaggcgacaggctggaggtgtctccagatacagagccccacaccgcatgggtggtggatagcccagcaggccggagaggcaagtctcctgcacggagcggcgtgaagtccgccagaccaagaaggcacaccgcaggaagggcaggatggaggggcctggacgccctgctggccgtgaacgccgtggaccaggatcagcaggcaacagcaacccggagcggcgccgtgtctagccagctggtgagacagctgtctgccatcagccgccggctgcctagccggtacccactgagagtggagctgaccggcatcgcctatggcaaccagtccgccgtgatcgaggacatgtacttcgatgagatcccactgcctgtggccgccctggaccccgagggcatcgtgtacggcgccctgctggaggtggtggaccaggccgaggatctggccaaggccgtgaatcacctgtccggcgacctgagaagggcagcaggctctgagccaatcccatgggacaagggacagaggcctggcgataccctgctgcacgccctggacccaatcgtgcgccggctgctggcaggactgaggcaggccggcgatgactttgataggtgtgagcagggcctggaggcctgggagcacaaggcaggacaggccacactgcgggtggcagagggcctgtttaatagcgccccagccgccctgttcaccggcagaagggtgaagaaggacggcaaggagcaggtgtatcgcctgtctacagcagaggccagcttccgccggagactggccgtgatcctgcacaggcgcgccgccgcccggaccgccggctaa

SEQ ID NO: 204 - DNA, 615 bp, Streptomyces sp. S4
  misc_feature (1)..(615): Cse2
atgtccacatctccactgtctgcccccgtgcctggccagagagtgtctagcctgccaaggccatactggtccggcagggcagatgagcagggacagtggcggaccagagcaggagagagcctgaggccacctggagaggacctgtccgccctgagagcaggactgggcaagaaggccttcacagagccaaggctgtggcagtactataccacacccacagatggccgcgtgaccctggagctggaggcagagcacgccgccctggccctgtacggactgcaccagcagagccaggagcagccaatgcacaggcagggcgtgcggaccggaagagccctgagggccctgcaccagcggtactctgaggaggcaacagacaggcgcgtggcacaggcagtgggagccaccagcgccgcagcctttgcctataggctgcgcgccctggtgacccagctgaggtctatcggccagccactggattacgaccagctgatgcaggatctgctgaggtggcacttccccgacggccggagcagagtgcggagaggatggggactgggataccacggaagggacaggcagcccgatgaggccccaccccctgagggcagctaa

SEQ ID NO: 205 - DNA, 1167 bp, Streptomyces sp. S4
  misc_feature (1)..(1167): Cas7
atgtcccagccagcagcaaggccacctagaacatacgtggactttcacatcctgcagaccgtgccacccgccaacctgaatcgggacgatcagggcaacccaaaggaggcctactatggcggcgtgcggagatccagagtgagctcccaggcctggaagagggcaacccgcacacacttcgcagagcgggtgcccgagcaggatctggcaaccagaacaaggaggatcatcggcgccctggcagacgatatccagaagagggccggcctggataggcctgccgccctgaggctggcagacgccctgctggccccactggagctgtccggcggcaagaagaaggacgagtctgcctacctgctgttttatggccggagacagctggatgcagtggccgccctggtggcagaccaggcaaccgagctgtctgccctgagcgatgcagacctggcatcccgggtgaaggagctgcccgtgagagagcagttttctacaggccaccctatcgacgtggccctgttcggcaggatggtggccgacatccctgccctgaaggtggatgcagcagcacaggtggcacacgccctgagcacacacgccgtggagctggagtttgattacttcaccgccgtggacgatgagcagacagacgaggagaccggagcaggaatgatcggaaccatcggcttcaacagcgccacactgtaccgctatgcctccgtgggactgcaccagctgctggacaatctgaccgatgaggaggccgccctgacagccatctccgagtttgccacctccttcgcccggtctatgcccacaggctatcagaactcttttgcccacaggaccctgcccagcctggtggcagtggtggtgcgcgaggaccagcctgtgaatctggtgagcgccttcgagcagccagtggccacaccatccggcatcgcagcagcatctgccgcaaggctggccgaggagcacacccgcgcaaccgtgacatggggcgatgcaccagcctttgccgcagcaacacacgtgttcaccgaccaccagaagaccacagccgccctgaacagcgcctttggccctagcatcccattctccgccctgctggagggactgcacacccacctggcaggcgccctgaagcctaagcaggcagcacagtaa

SEQ ID NO: 206 - DNA, 882 bp, Streptomyces sp. S4
  misc_feature (1)..(882): Cas5
atgaccacagcacctacaccagagccagcaggaaatacccacccagcacacggctccgatgagcctaccgtgctgctgctgaggctggcaggaccactgcagtcttggggcgtgagatcctcttttaacaggagggacacaggagcagagccaaccaagtccggcgtgatcggactgctggcagcagcagcaggacaccctagagagcagccactgggagagctggcagatctgaccctgggcatcagggtggaccagccaggcacactgctgagggactaccacaccgtgagcgattataggggcagacctctgccacaggcaggcgtgtctgccaagggcatccagaagcccaccagccctgccaagcacacacacgtgaccacaaggttttacctgcaggatgccgtgttcgtggccgccctggagggacctccaggactgctgaccacactggacagggccgtgcggaatccagcattcccactggccctgggccggagaagctgtccacctacccagccactgtccctgggactgcggaccacagatatggagacagccctgagatctgagccttggcaggccagcgcccacaccagagagcagtatgcaaggcgcctgggaagggagaggggactgcaccagcctctgcacccaggaaccatcgacagggcagcaacaatcgaggaccccaggggcgacgataggctgcaggacgcacccgtgagctttgatcctcaccagagggccttcacctccagacaggtgaggcacacctggctggccatccccacaggctttgaccacatcgacgatgaccagcctcacggacaggcagatgaccccgatcacgaccctttcgccctgctgggatggtaa

SEQ ID NO: 207 - DNA, 813 bp, Streptomyces sp. S4
  misc_feature (1)..(813): Cas6
atgacatacctgtcccggatcagaatcaacccactgcggaaggacagccggaagctgctgagcaatccaagggcagtgcacggagccgtgatgggaggcctgccaaaccacaagcccgatgacagggtgctgtggcgcatggaccccgacaatcctcacaggccacacctgtttgtgctgagccccacacgccctgactggacccacatcatccaggattgtggctggccagatgcagacggcgatcacgcagccgtgagagactataccccactgctgagccagctggcagtgggaagagagttcgcctttaggctgacagcctcccccgtgcagaacaccgccacaccaaccaaggcaaccccagcacaggcagcaaggctgaccacacacgccgagaatggcaagcggatcagaggcttcagaatgggacacagaaccgcagcagcacagctggattggtttctgacacgcaccgaccggtggggcttcgatatccctgcaacaagatctgacccagcagcaccaggcatccacgcaccaacacctccaaccgcaccaaggcctacaagcccacctagaccagatcccaacccaccatacgaggtgcgcatcaccgcaaggcacagacactcctttcagaagaatggccacggcgcccacgtggtgtttcggtctgccaccttcgagggcaggctgcgcatcacagacaccgatcggttcaccacatctctgctgacaggcctgggccctagcagagcctatggatgcggactgctgacactggcacctctgccaggacagcagacctaa

SEQ ID NO: 208 - protein, 580 aa, Streptomyces sp. S4
  misc_feature (1)..(580): Cas8
MPGKGGASVNLLSDGWLSAVSAGGGSGFGGGPGAGPAEFGVRELLLNAEKFADIVVDLPTQRPAVFRQVLLPLVVDALGCPKDAEAWMDMFRAGAFSPEQRQVLADYLDKHQHLFGLLDPVEPFGQVADLRTAKGETKGSALLVATAATGNNVPLFSSRTEGDVLELTPAEAARWLLHTHCWDTAAIKTGAVGDPMVKSGKTTGNPTGPLGQLGVTMPVGSTLFETLLLNIPYGQAGLSDDVPQWRRRSTQGDVKDTLSCATPVWQSRPARGLLEAWTWQARRIRLISQDTDRGPRITRVLVAAGDRLEVSPDTEPHTAWVVDSPAGRRGKSPARSGVKSARPRRHTAGRAGWRGLDALLAVNAVDQDQQATATRSGAVSSQLVRQLSAISRRLPSRYPLRVELTGIAYGNQSAVIEDMYFDEIPLPVAALDPEGIVYGALLEVVDQAEDLAKAVNHLSGDLRRAAGSEPIPWDKGQRPGDTLLHALDPIVRRLLAGLRQAGDDFDRCEQGLEAWEHKAGQATLRVAEGLFNSAPAALFTGRRVKKDGKEQVYRLSTAEASFRRRLAVILHRRAAARTAG

SEQ ID NO: 209 - protein, 204 aa, Streptomyces sp. S4
  misc_feature (1)..(204): Cse2
MSTSPLSAPVPGQRVSSLPRPYWSGRADEQGQWRTRAGESLRPPGEDLSALRAGLGKKAFTEPRLWQYYTTPTDGRVTLELEAEHAALALYGLHQQSQEQPMHRQGVRTGRALRALHQRYSEEATDRRVAQAVGATSAAAFAYRLRALVTQLRSIGQPLDYDQLMQDLLRWHFPDGRSRVRRGWGLGYHGRDRQPDEAPPPEGS

SEQ ID NO: 210 - protein, 388 aa, Streptomyces sp. S4
  misc_feature (1)..(388): Cas7
MSQPAARPPRTYVDFHILQTVPPANLNRDDQGNPKEAYYGGVRRSRVSSQAWKRATRTHFAERVPEQDLATRTRRIIGALADDIQKRAGLDRPAALRLADALLAPLELSGGKKKDESAYLLFYGRRQLDAVAALVADQATELSALSDADLASRVKELPVREQFSTGHPIDVALFGRMVADIPALKVDAAAQVAHALSTHAVELEFDYFTAVDDEQTDEETGAGMIGTIGFNSATLYRYASVGLHQLLDNLTDEEAALTAISEFATSFARSMPTGYQNSFAHRTLPSLVAVVVREDQPVNLVSAFEQPVATPSGIAAASAARLAEEHTRATVTWGDAPAFAAATHVFTDHQKTTAALNSAFGPSIPFSALLEGLHTHLAGALKPKQAAQ

SEQ ID NO: 211 - protein, 293 aa, Streptomyces sp. S4
  misc_feature (1)..(293): Cas5
MTTAPTPEPAGNTHPAHGSDEPTVLLLRLAGPLQSWGVRSSFNRRDTGAEPTKSGVIGLLAAAAGHPREQPLGELADLTLGIRVDQPGTLLRDYHTVSDYRGRPLPQAGVSAKGIQKPTSPAKHTHVTTRFYLQDAVFVAALEGPPGLLTTLDRAVRNPAFPLALGRRSCPPTQPLSLGLRTTDMETALRSEPWQASAHTREQYARRLGRERGLHQPLHPGTIDRAATIEDPRGDDRLQDAPVSFDPHQRAFTSRQVRHTWLAIPTGFDHIDDDQPHGQADDPDHDPFALLGW

SEQ ID NO: 212 - protein, 270 aa, Streptomyces sp. S4
  misc_feature (1)..(270): Cas6
MTYLSRIRINPLRKDSRKLLSNPRAVHGAVMGGLPNHKPDDRVLWRMDPDNPHRPHLFVLSPTRPDWTHIIQDCGWPDADGDHAAVRDYTPLLSQLAVGREFAFRLTASPVQNTATPTKATPAQAARLTTHAENGKRIRGFRMGHRTAAAQLDWFLTRTDRWGFDIPATRSDPAAPGIHAPTPPTAPRPTSPPRPDPNPPYEVRITARHRHSFQKNGHGAHVVFRSATFEGRLRITDTDRFTTSLLTGLGPSRAYGCGLLTLAPLPGQQT

SEQ ID NO: 213 - DNA, 90 bp, Streptomyces sp. S4
  misc_feature (1)..(90): CRISPR
gtcggccccgcacccgcggggatgctccaatggccgaggacgacggcgatctggccacggacgtcggccccgcacccgcggggatgctcc

SEQ ID NO: 214 - DNA, 744 bp, Fusobacterium nucleatum subsp. animalis 3_1_33
  misc_feature (1)..(744): Cas6
atggaagtttacgaaatgaaattaaaagtaaaacttaaaaaagatatttttttaaaagatgtttccacatatatcacaagatttatggatatgaatctatcagctaatccaacaatgtacaattatcatacttctaaaatctacaaaggatatacatttgacggactattcccgatagaagaagataaaatatataaaaaagataaaacttattcttttagagtaagaacaataaatcaaaaaatagctaactattttttagatactcttatgttctttgaaaataaagatattcaaggtttgacattaaatataagggtgatagagaaaaaattaattgaaaagttatatacaataactcctattttaatgaaaacagatgagggatattggagatattctatgacttttgaagaatttgaaaaaagattaaaaataaactgtttaaagaagtatttatactttacagagaataatgatgatataactattgatactgaacttttaaaaaaattaggagaagataaatctgatgatatagatttatttactaatattaagtttattaatagaatgcctgtcccaattatttataagggaagaaaattagttggagataaggttgaactacaagttgccaataatgagaaagcacaagatattgcatatatgcttttaggaacagggcttttagaaaattgtgcaaggggttgcggcttcttgaatttcaaaaattatgagtag

SEQ ID NO: 215 - DNA, 1728 bp, Fusobacterium nucleatum subsp. animalis 3_1_33
  misc_feature (1)..(1728): Cas8
ttgattgatgaagcattagaagtatttaaaaaaatttatgataaggagggggaaaaacttgttgtaaacaaacatattccaaaagatggaacatatattttagtaaatataaaatcaggaaaaataatagaaaaattaaatattttctatgataaaaaaagtaaaaaaatagatggtgaacttaatcaatactatggctattttagagcttttgattattattctaatttagtagatatgaataaaccaatggatccaaaaaagacaatacattcaaatcagatttattcattttttataaaaaaagatagcataagagaaaataaattaactaaatcaattattgaaggatataaaaaaaatcttttaaacccagaagaaaaatacaatagtaaggaagggaaagagctatataaaaatatagcagaaaagcttcctaaaattgaaaaagatattgtagaggatatttttttatggatagaagataatgtaaatgaaaatttattagaaaatgacaataaaaaagattacttaaaaatattttttgtagaagaggatttagataaaagtttagaactatttaaaaatgaacataaaagatatattattcctaatatttttaattctaatgattataataaaaaaattggagagactatttatggattgtctaataataatatgggattaaatgcaaaaaaagcatttttggaaaataagacaagaagagtatcaaccccatatttagttaatactgatgaaatacttttacaatatgctttctataattatttattaccagaagtaaaacaaggaaattattttatttatttttcagaaaatgaaattattcctaggacatataaagaaggctgtcctaatggagcaaaatatttattaaatgctagttattcaaaagatgttgatataaaaaattttaatgtaatctcaaaaaatagtagcgaagaaataaatattaattttaaagaaattttacatcaaaagaaaaaagatacagatgagattgaatatggaaatcttaatagagaaaagatgatgaataatataaataaaattcttttctataattctttattaggaaattttttactcagtgatggagatttggatataaaggatattgagataaaaaaactgttaatgaaatatagaaatgctttttataagtggttttatttaaatgatgaagcagaagtcaaaaaaaatattagaaaaatatatctggatgctgtaatggtggcaataggaaatggatatttctttaaagcaagtcaacaacttgattttggcttttgtttggaaaagtatttttatggaaaaagtgagttaatggaggaaattatgaatgtaaaagaagtatttttaaatcatactttatcagaagaagattgggagtttttaaatgatgaagagtattttttcgcagttgggcaaatattagcgtacataaattatatgagaaatagtaaagctaaaagtttgaattttataaaacaactaacttttgttaaaaatattgatgttctaaaagaaaagataaagaaaatagtaatttcatattcacatatttttgaaactaaaaataaaaaaattaatagaacagtatcaaatattagtttgtaccaaccaaaagaaataagaatagatatattattagcaggatttacagcagatataattttctttaaaaagagggaggaaaaataa

SEQ ID NO: 216 - DNA, 948 bp, Fusobacterium nucleatum subsp. animalis 3_1_33
  misc_feature (1)..(948): Cas7
atgaaaatggaaaaaagagtttatggaattttaggaatatcatctattatgtctaattggaatgcagatttcagtggagagcctaagtcaatttctaatggaagaatatttgggagtgataaggcatttaagtatcctatgaaaaaaatgtgggaaaatcaaggagaaaaagttctttatataaaatctttaaaagttgataaaggagctttaattcctaagactttaaaggaaagatatgagcaattatttccagaaaaaaaacttgataaaaatacagaaacaatagaagttattaagaacttatttaaagccatagatgtaaaaaattttggagcaacatttgcagaagaaggaaataatatttctatcacaggggcagttcaaataggacaaggttttaatttctatgatgaaagtaacacagaagttcaagatattctatctccatttagagatccaaaaggaaaaattaataaagaaacaaaagaaaatgaagatgcaaagaactctactttgggaactaaaatagttagtgatgaggcacactatttttatccttttaatataaatcctttggcatataaagaatttatagaattagaaataactgatggatatacagaagaagattatttgaagtttaaagaagcagctttatcatcagcaactttttttgcaacaaattcaaaagttggctgtgataatgaatttggactattcattgaaacagaagaagatttttatttaccaattttaactcaatatataaaatttgaaaagggagaagaaaaaaataaaataactcttaatttaagtactatattaaaaggagtagaaaatcatatcaaaaatatagaaatatactataatccagtaactactgaaattgtaactgatatttctaactataagttgataaatattttaactaagaaagaggtataa

SEQ ID NO: 217 - DNA, 771 bp, Fusobacterium nucleatum subsp. animalis 3_1_33
  misc_feature (1)..(771): Cas5
atggaagcactgaaatttactttaagtggtaatagtgccttttttaaagataatgtaatcaacactgtttatttaacatatggaaatatacatagagtagctttattaggaatgtttggagcaattttaggctatggtggatatagtaaacaaaatgatatgttgaagaaaaaaaataaaaagatgcctgattatccagaattttatgagaaactaaaagatattaaaatatcaatagtttccaacggaaaaaatggttattttaataaaaagttacaaacatttaataatagtgttggttatgcgtcaaaagaagaaggtggaaatttaatagtaaaacaattctggttagaaaatccttcttgggatatttatatattgttagattgtgatgaagcaaagaaaatagcagactatatacagaataggaaagctatttatcttccatatcttggaagcaatgaccatttagcaaatataatggatgtagagataatagatattgaagaaaagatgagttcagaagatgaaactattgaaattctttctatggtaaaagatagtgatatatcagaaaaaaagaaaaatgtatttagtatagataaaaattcaataagagatgatatatataaatattctgaatatttaccagttaccttatcaaaagaattaaatcaatatgaaaaagaaaaaatgacaattactaatatgtctgttatattaaaaaaatcttattataaagtggaagataaaaacattgttttctattaa

SEQ ID NO: 218 - DNA, 744 bp, Fusobacterium nucleatum subsp. animalis 3_1_33
  misc_feature (1)..(744): Cas6
atggaggtgtacgagatgaagctgaaggtgaagctgaagaaggatatctttctgaaggacgtgagcacctatatcacaagattcatggatatgaacctgtccgccaatccaaccatgtacaactatcacacatctaagatctacaagggctatacctttgacggcctgttccccatcgaggaggataagatctacaagaaggacaagacctatagctttcgggtgagaacaatcaaccagaagatcgccaattacttcctggataccctgatgttctttgagaataaggacatccagggcctgacactgaacatcagagtgatcgagaagaagctgatcgagaagctgtacaccatcacacctatcctgatgaagaccgatgagggctactggcggtattctatgacatttgaggagttcgagaagagactgaagatcaactgcctgaagaagtacctgtatttcaccgagaacaatgacgatatcaccatcgacacagagctgctgaagaagctgggcgaggataagagcgacgatatcgacctgtttacaaacatcaagttcatcaataggatgcccgtgcctatcatctacaagggccgcaagctggtgggcgataaggtggagctgcaggtggccaacaatgagaaggcccaggacatcgcctatatgctgctgggaaccggactgctggagaattgcgcacggggctgtggctttctgaacttcaagaattacgagtaa

SEQ ID NO: 219 - DNA, 1728 bp, Fusobacterium nucleatum subsp. animalis 3_1_33
  misc_feature (1)..(1728): Cas8
atgatcgatgaggccctggaggtgtttaagaagatctacgacaaggagggcgagaagctggtggtgaataagcacatccccaaggacggcacatatatcctggtgaatatcaagtctggcaagatcatcgagaagctgaacatcttctacgataagaagagcaagaagatcgacggcgagctgaaccagtactatggctattttcgcgccttcgattactatagcaacctggtggatatgaataagcctatggacccaaagaagaccatccacagcaatcagatctattccttctttatcaagaaggactctatccgggagaacaagctgacaaagagcatcatcgagggctacaagaagaacctgctgaatcctgaggagaagtacaattccaaggagggcaaggagctgtataagaacatcgccgagaagctgccaaagatcgagaaggatatcgtggaggacatcttcctgtggatcgaggacaatgtgaacgagaatctgctggagaacgataataagaaggactatctgaagatcttctttgtggaggaggacctggataagagcctggagctgtttaagaacgagcacaagaggtacatcatccctaacatcttcaactccaacgattacaataagaagatcggcgagaccatctatggcctgtctaacaataacatgggcctgaacgccaagaaggcctttctggagaataagaccaggcgcgtgagcacaccctacctggtgaatacagacgagatcctgctgcagtatgccttctacaactatctgctgcctgaggtgaagcagggcaactactttatctatttctccgagaatgagatcatcccaagaacctacaaggagggctgccccaacggcgccaagtacctgctgaatgcctcttatagcaaggacgtggatatcaagaactttaatgtgatctccaagaatagctccgaggagatcaacatcaatttcaaggagatcctgcaccagaagaagaaggacacagatgagatcgagtacggcaacctgaatagggagaagatgatgaacaacatcaacaagatcctgttttataactccctgctgggcaatttcctgctgtctgacggcgatctggacatcaaggatatcgagatcaagaagctgctgatgaagtaccgcaatgccttttacaagtggttctatctgaacgatgaggccgaggtgaagaagaatatcagaaagatctacctggacgccgtgatggtggccatcggcaacggctatttctttaaggccagccagcagctggactttggcttctgtctggagaagtacttctatggcaagtccgagctgatggaggagatcatgaacgtgaaagaggtgtttctgaatcacaccctgagcgaggaggattgggagttcctgaacgacgaggagtacttctttgccgtgggccagatcctggcctacatcaactatatgcgcaattccaaggccaagagcctgaacttcatcaagcagctgacattcgtgaagaacatcgacgtgctgaaggagaagatcaagaagatcgtgatctcctattctcacatctttgagaccaagaacaagaagatcaataggacagtgtctaacatcagcctgtaccagccaaaggagatccgcatcgatatcctgctggccggcttcaccgccgacatcatcttctttaagaagcgggaggagaagtaa

SEQ ID NO: 220 - DNA, 942 bp, Fusobacterium nucleatum subsp. animalis 3_1_33
  misc_feature (1)..(942): Cas7
atggagaagagagtgtacggcatcctgggcatcagctccatcatgtccaattggaacgccgatttctctggcgagcctaagtctatcagcaatggcagaatctttggctccgacaaggccttcaagtacccaatgaagaagatgtgggagaaccagggcgagaaggtgctgtatatcaagtctctgaaggtggataagggcgccctgatccccaagaccctgaaggagaggtacgagcagctgtttcctgagaagaagctggataagaacaccgagacaatcgaagtgatcaagaatctgttcaaggccatcgacgtgaagaactttggcgccaccttcgccgaggagggcaacaatatcagcatcacaggcgccgtgcagatcggccagggcttcaacttttacgacgagagcaataccgaggtgcaggatatcctgtcccccttcagagaccctaagggcaagatcaacaaggagacaaaggagaacgaggatgccaagaatagcaccctgggcacaaagatcgtgtccgacgaggcccactacttttatccattcaatatcaaccccctggcctacaaggagtttatcgagctggagatcaccgatggctacacagaggaggactatctgaagttcaaggaggccgccctgtctagcgccaccttctttgccacaaactccaaagtgggctgcgataatgagtttggcctgttcatcgagaccgaggaggacttttacctgccaatcctgacacagtatatcaagttcgagaagggcgaggagaagaacaagatcaccctgaatctgtctacaatcctgaagggcgtggagaaccacatcaagaatatcgagatctactataatcccgtgaccacagagatcgtgaccgatatcagcaactacaagctgatcaatatcctgacaaagaaggaagtgtaa

SEQ ID NO: 221 - DNA, 771 bp, Fusobacterium nucleatum subsp. animalis 3_1_33
  misc_feature (1)..(771): Cas5
atggaggccctgaagtttacactgagcggcaattccgccttctttaaggacaacgtgatcaataccgtgtacctgacatatggcaacatccacagggtggccctgctgggcatgtttggcgccatcctgggctacggcggctattctaagcagaacgacatgctgaagaagaagaacaagaagatgccagattaccccgagttctatgagaagctgaaggacatcaagatctctatcgtgagcaacggcaagaatggctactttaataagaagctgcagaccttcaacaatagcgtgggctatgcctccaaggaggagggcggcaatctgatcgtgaagcagttctggctggagaacccctcctgggatatctacatcctgctggactgcgatgaggccaagaagatcgccgactatatccagaaccgcaaggccatctacctgccttatctgggctccaacgatcacctggccaatatcatggatgtggagatcatcgacatcgaggagaagatgtcctctgaggacgagaccatcgagatcctgtctatggtgaaggactccgatatctctgagaagaagaagaacgtgttcagcatcgacaaaaatagcatccgggacgatatctacaagtattctgagtacctgcctgtgacactgagcaaggagctgaatcagtatgagaaggagaagatgaccatcacaaacatgagcgtgatcctgaagaagtcctactataaggtggaggataagaatatcgtgttctactaa

SEQ ID NO: 222 - protein, 247 aa, Fusobacterium nucleatum subsp. animalis 3_1_33
  misc_feature (1)..(247): Cas6
MEVYEMKLKVKLKKDIFLKDVSTYITRFMDMNLSANPTMYNYHTSKIYKGYTFDGLFPIEEDKIYKKDKTYSFRVRTINQKIANYFLDTLMFFENKDIQGLTLNIRVIEKKLIEKLYTITPILMKTDEGYWRYSMTFEEFEKRLKINCLKKYLYFTENNDDITIDTELLKKLGEDKSDDIDLFTNIKFINRMPVPIIYKGRKLVGDKVELQVANNEKAQDIAYMLLGTGLLENCARGCGFLNFKNYE

SEQ ID NO: 223 - protein, 575 aa, Fusobacterium nucleatum subsp. animalis 3_1_33
  misc_feature (1)..(575): Cas8
MIDEALEVFKKIYDKEGEKLVVNKHIPKDGTYILVNIKSGKIIEKLNIFYDKKSKKIDGELNQYYGYFRAFDYYSNLVDMNKPMDPKKTIHSNQIYSFFIKKDSIRENKLTKSIIEGYKKNLLNPEEKYNSKEGKELYKNIAEKLPKIEKDIVEDIFLWIEDNVNENLLENDNKKDYLKIFFVEEDLDKSLELFKNEHKRYIIPNIFNSNDYNKKIGETIYGLSNNNMGLNAKKAFLENKTRRVSTPYLVNTDEILLQYAFYNYLLPEVKQGNYFIYFSENEIIPRTYKEGCPNGAKYLLNASYSKDVDIKNFNVISKNSSEEININFKEILHQKKKDTDEIEYGNLNREKMMNNINKILFYNSLLGNFLLSDGDLDIKDIEIKKLLMKYRNAFYKWFYLNDEAEVKKNIRKIYLDAVMVAIGNGYFFKASQQLDFGFCLEKYFYGKSELMEEIMNVKEVFLNHTLSEEDWEFLNDEEYFFAVGQILAYINYMRNSKAKSLNFIKQLTFVKNIDVLKEKIKKIVISYSHIFETKNKKINRTVSNISLYQPKEIRIDILLAGFTADIIFFKKREEK

SEQ ID NO: 224 - protein, 313 aa, Fusobacterium nucleatum subsp. animalis 3_1_33
  misc_feature (1)..(313): Cas7
MEKRVYGILGISSIMSNWNADFSGEPKSISNGRIFGSDKAFKYPMKKMWENQGEKVLYIKSLKVDKGALIPKTLKERYEQLFPEKKLDKNTETIEVIKNLFKAIDVKNFGATFAEEGNNISITGAVQIGQGFNFYDESNTEVQDILSPFRDPKGKINKETKENEDAKNSTLGTKIVSDEAHYFYPFNINPLAYKEFIELEITDGYTEEDYLKFKEAALSSATFFATNSKVGCDNEFGLFIETEEDFYLPILTQYIKFEKGEEKNKITLNLSTILKGVENHIKNIEIYYNPVTTEIVTDISNYKLINILTKKEV

SEQ ID NO: 225 - protein, 256 aa, Fusobacterium nucleatum subsp. animalis 3_1_33
  misc_feature (1)..(256): Cas5
MEALKFTLSGNSAFFKDNVINTVYLTYGNIHRVALLGMFGAILGYGGYSKQNDMLKKKNKKMPDYPEFYEKLKDIKISIVSNGKNGYFNKKLQTFNNSVGYASKEEGGNLIVKQFWLENPSWDIYILLDCDEAKKIADYIQNRKAIYLPYLGSNDHLANIMDVEIIDIEEKMSSEDETIEILSMVKDSDISEKKKNVFSIDKNSIRDDIYKYSEYLPVTLSKELNQYEKEKMTITNMSVILKKSYYKVEDKNIVFY

SEQ ID NO: 226 - DNA, 96 bp, Fusobacterium nucleatum subsp. animalis 3_1_33
  misc_feature (1)..(96): CRISPR
atgaactgtaaacttgaaaagttttgaaatgttgacaaatattcagataatttttcaaaatcttttatgaactgtaaacttgaaaagttttgaaat

SEQ ID NO: 227 - DNA, 723 bp, Campylobacter fetus subsp. testudinum Sp3
  misc_feature (1)..(723): Cas6
atggatgtgaaaatatatcagctgaaagtatttttaaagttaaatcaaaatgtagattttataaatagccctgagtttttaagcacaaatttacataaagctatgttgggggatgaagctctacgatctattcatatgcaaagatatttaaagccttatagcatcggttttttatacagtatgaaaggcaaaaaagatacttttgtgagtggtgaagatatgtatttttacgtaagaagtattgatgagagttttatatctaagttaagaatttgtttagaaaattctaaaaatcttgggtttaatgtatatttatctaaatttgaaaatttggatataaagcaagtcgatcgtttatatactatgagtccggcaactatcgtgcttaaagaaggcgataaaactataccttggagacgtgaaaatagcgatataacagtgcttaaagaagctttgatttcaaatttaaaaaacaaatacgaatattttttagacaaaaaaattgagataaaagatgatatcatcgaacttatagagataaaaacaaatagagcgtttgcatttagatataaaaacggtaaaatttatgcttatagatatcaaattcacttttcccaaaacagattggctcaagagtttgcaaatatcgccatgatacttggtgttggagttaaaaatacattgggatttggcttttgtatgaggagtaataatgctgtttga

SEQ ID NO: 228 - DNA, 1692 bp, Campylobacter fetus subsp. testudinum Sp3
  misc_feature (1)..(1692): Cas8
atgctgtttgaattgcttgatgagtttaaaaaacagcttgaaaaaaataagcacatagtcacacaaaatcacattttaaaagacggagtttatgcgagaatttccgatgaaaaatgtgagattttttacgtaaaaactatcacagaaaaaataggtaaaactgcgcagaaaagaacgattttatacaaacaaaacggagatatcgcgttaaatgatgatatgcagtggtttgagcaagctgattatttaagtttcttatgggatatgaataaagctgttttgcctaataaaaaatttcacagcattaactttttgtctctattttttaagcttgaagagtctgagtatgttaaggaaaatttggaagagtattttgatatttttagagattatagtgcatttaataaagcaaaagataaggaaattttatcattttatatggattatataaaagatgaaaatagacaaaacttgatcacaaattcagtagttttatctaaaaaatattttaatgatataaatgattttgctgtacaaaataactttaaaaagtgttatattaagttttttattgacaaagattttgagatttatgaaaaagagtcgcaaatttatattgatttgaaaatttacaattcaaatgaacacaatataaaatataataatgaaattttcggtctttcaaatttcaatatgggtatgaattcaaaaaaaccttttttagagcataaaaatagattatttaaaataccttacgccataagtcaaaaagacgctcttgctagtaaaatgctttttgattggcttggttcgcaaaataaaagaattattcgtgattttaactcaatctttatatctaaattcaataaacaatcaaaagccgtggtaagtgacttcgagtatgttcctgtagataaaaataagtttaaatttgataaatttaaacttaaaaattttatgaatattgaaaatggtgaaaaagagatacttagttttgatgattttaagcaagttattgatgagcagctttatcataaatgtctttttggtaatttgtataatgatgagataagagttagtaaaagaatcagcgaagatatgcaaaatttactttatcaaactagatgttctatggtggagtattttgataaatttaataacaatgaattttactatgttatacaaaaatattctaatgattttattaaaattgctatgcaagatagtgaatttggtagattaaacggtaaaaaatctataaatttgctacttagtataaaagaaattaaaggagaaaaagtggatatagacgggataaaaaatagagttatatcagcacttactgatgataatgtaactaaattaagcggaaatgaatactactttttagtaggtaatttagcaatgtatctagttagtaaaagcaagacttggaaaaagacgtttgcactaactgacccatacactaaagctagaaatacaaaaaagctaaaaatggctctgtttattgattttgatagatacaactatgatatttttttagaaaatggaatattaaaaaaagcattttcattggctcaaaattgtgaagatatagttatgtcaaataacgaccaacagatggttttaatcggtatgatgacaaaaaatataattaagaaaccaggagaaaaagatgaaattagcgaatag

SEQ ID NO: 229 - DNA, 942 bp, Campylobacter fetus subsp. testudinum Sp3
  misc_feature (1)..(942): Cas7
atgaaattagcgaatagaatttatggaataatcggtataaaatcaactatggccaactggaatgcagattttagcggcagaccaaaaagcacaggaaacggagatatctttgctagtgataaagctttaaaatatcctatgaaaaagatgtgggaaagctatggaaaaaatattctttttgtaaaatctctaaaacaaggcaagagtaaggatggcaatgacaagctcgtgccaaatactctaggagaaagatatggtttgctttttggcgatatcaaaaaagcaaaatccacaaaagaggttttgagtaacctttttaactgcattgatgttaaaaatttcggtgctacattccctgaagatggttataacttatcaataactggtgcagttcagataggacaaggatttaataaatttggagatataaatatagaagttcaaaatatcttatctccatttgccgattcaagagctaaagagaaaaacgaaaatggagaagatgcgagccaaagcactctgggtacaaaaatagttacagatgaggctcattatttttacggattttgcataaatccgttagcttataatgattataaagagattttgggtgatgattttggttacaatgaagatgattacgctgagttcaaaaaggctgctagattttgcgctacgtattttaattccaactcaaaattcggctgcgaaaatgagtttgctatgttcattgaaacagccgtagatgcatatctgcctgatcttagttcatatatggattttatttgcaaagataaaaatagattggtaaatttagaaaaaatagaaaaaatgatagaaagttcagatgtaaaaaaagtagaaatttattacaatcctttatctttggacgtagaaactaaatttgataaattcgatatttacagtggaaataaaatatga

SEQ ID NO: 230 - DNA, 762 bp, Campylobacter fetus subsp. testudinum Sp3
  misc_feature (1)..(762): Cas5
atgaaagccataagttttaagcttagcggaaagtttgcacatttcaaaaaaccagatgtaaatgaatatgtgtattttacttataataatatcccaaaaccaactctattagggcttttgggggccattatagggcttaaaggatacgcgcaaaaaacttataataataaaaaagataaaaaatcacttttaaacaatgaaaacagaagtaacgagccggaattttatgagcgtttaaaacatcttaaaatttgtattattcctcttgttaaatatggtaaattttctaaaaaaattcaagttttcaataattcagtaggatacgcaagcaccgaagaaggtggaaatttaatagttagagagcaatggcttgaaaatccttcttggcagatacttatagaagatgacggaagtgcggagtttgagactatttcacaatatctatttgataaaaaagctaagtttataccatatcttggtaaaaatgaccattttgcagatataagcgaagtggagaaaatagatcttgcagagtctaaaaaagataaaattgtgataaaatcgctgtttttggataatttagcaaagcaggttgatgaccctgatgatgagatatcatatctttttaatgaattttatcctattggttttaatgaacttatgttttataagcttgaaaaaactacttttacaaatcaaatttgtcaagcaatggacgggaaatggtatgagtttaaagacggaactatatgcttcttttaa

SEQ ID NO: 231 - DNA, 723 bp, Campylobacter fetus subsp. testudinum Sp3
  misc_feature (1)..(723): Cas6
atggatgtgaagatctaccagctgaaggtgttcctgaagctgaatcagaacgtggacttcatcaacagcccagagtttctgtccaccaatctgcacaaggccatgctgggcgatgaggccctgaggtccatccacatgcagcggtacctgaagccctactctatcggctttctgtacagcatgaagggcaagaaggacacatttgtgagcggcgaggatatgtacttctatgtgcggtccatcgacgagtctttcatcagcaagctgagaatctgcctggagaattctaagaacctgggctttaacgtgtatctgagcaagttcgagaatctggacatcaagcaggtggataggctgtacaccatgagccctgccacaatcgtgctgaaggagggcgataagaccatcccatggcggagagagaactccgacatcacagtgctgaaggaggccctgatctctaatctgaagaacaagtacgagtatttcctggacaagaagatcgagatcaaggacgatatcatcgagctgatcgagatcaagaccaatcgggccttcgcctttagatataagaacggcaagatctacgcctataggtaccagatccactttagccagaaccgcctggcccaggagttcgccaatatcgccatgatcctgggcgtgggcgtgaagaataccctgggcttcggcttttgcatgaggtccaacaatgcagtgtaa

SEQ ID NO: 232 - DNA, 1692 bp, Campylobacter fetus subsp. testudinum Sp3
  misc_feature (1)..(1692): Cas8
atgctgttcgagctgctggatgagtttaagaagcagctggagaagaacaagcacatcgtgacacagaatcacatcctgaaggatggcgtgtatgcccgcatctccgacgagaagtgtgagatcttctacgtgaagaccatcacagagaagatcggcaagaccgcccagaagcggacaatcctgtataagcagaacggcgacatcgccctgaatgacgatatgcagtggtttgagcaggccgactacctgagcttcctgtgggatatgaacaaggccgtgctgcccaataagaagttccacagcatcaactttctgtccctgttctttaagctggaggagtccgagtacgtgaaggagaatctggaggagtattttgacatcttcagagattactccgcctttaacaaggccaaggataaggagatcctgtctttctatatggactacatcaaggatgagaataggcagaacctgatcaccaattctgtggtgctgagcaagaagtacttcaatgacatcaacgattttgccgtgcagaacaatttcaagaagtgctacatcaagttctttatcgacaaggatttcgagatctacgagaaggagagccagatctatatcgacctgaagatctacaattccaacgagcacaacatcaagtataacaatgagatcttcggcctgtctaacttcaacatgggcatgaatagcaagaagccatttctggagcacaagaaccgcctgttcaagatcccctacgccatctcccagaaggatgccctggcctctaagatgctgtttgactggctgggcagccagaacaagcggatcatcagagactttaattccatcttcatctctaagtttaacaagcagtctaaggccgtggtgagcgacttcgagtacgtgcccgtggataagaacaagtttaagttcgacaagttcaagctgaagaacttcatgaacatcgagaatggcgagaaggagatcctgagctttgacgatttcaagcaggtcatcgatgagcagctgtatcacaagtgcctgtttggcaacctgtacaatgatgagatcagggtgagcaagcgcatctccgaggacatgcagaatctgctgtatcagacccggtgttccatggtggagtactttgacaagttcaacaataacgagttctactatgtgatccagaagtactctaacgacttcatcaagatcgccatgcaggacagcgagttcggccgcctgaacggcaagaagagcatcaatctgctgctgtccatcaaggagatcaagggcgagaaggtggacatcgatggcatcaagaatagagtgatctccgccctgaccgacgataacgtgacaaagctgtctggcaatgagtactattttctggtgggcaacctggccatgtacctggtgagcaagtccaagacctggaagaagacattcgccctgaccgatccatatacaaaggcccggaacaccaagaagctgaagatggccctgtttatcgacttcgatagatataactacgacatctttctggagaatggcatcctgaagaaggccttcagcctggcccagaattgtgaggatatcgtgatgtccaataacgaccagcagatggtgctgatcggcatgatgacaaagaacatcatcaagaagcccggcgagaaggacgagatcagcgagtaa

SEQ ID NO: 233 - DNA, 942 bp, Campylobacter fetus subsp. testudinum Sp3
  misc_feature (1)..(942): Cas7
atgaagctggccaaccgcatctacggcatcatcggcatcaagagcaccatggccaattggaacgccgacttttctggccgccccaagagcacaggcaatggcgacatcttcgccagcgataaggccctgaagtatcctatgaagaagatgtgggagtcctacggcaagaacatcctgttcgtgaagtccctgaagcagggcaagtctaaggacggcaacgataagctggtgccaaataccctgggcgagcggtatggcctgctgtttggcgatatcaagaaggccaagagcacaaaggaggtgctgtccaatctgttcaactgcatcgatgtgaagaattttggcgccaccttcccagaggacggctacaacctgagcatcacaggcgccgtgcagatcggccagggctttaacaagttcggcgacatcaacatcgaggtgcagaatatcctgtcccccttcgccgatagccgggccaaggagaagaatgagaacggagaggacgcctcccagtctaccctgggcacaaagatcgtgaccgatgaggcccactacttttatggcttctgtatcaaccccctggcctataatgactacaaggagatcctgggcgacgattttggctataatgaggacgattacgccgagttcaagaaggccgccagattctgcgccacctactttaatagcaactccaagtttggctgtgagaacgagtttgccatgttcatcgagacagccgtggacgcctatctgcctgatctgagctcctacatggacttcatctgcaaggataagaacaggctggtgaatctggagaagatcgagaagatgatcgagtctagcgatgtgaagaaggtggagatctactataatcctctgtccctggacgtggagaccaagtttgacaagttcgatatctattctggcaacaagatctaa

SEQ ID NO: 234 - DNA, 762 bp, Campylobacter fetus subsp. testudinum Sp3
  misc_feature (1)..(762): Cas5
atgaaggccatcagctttaagctgtccggcaagtttgcccacttcaagaagccagacgtgaacgagtacgtgtacttcacctacaacaatatccccaagcctacactgctgggactgctgggagcaatcatcggcctgaagggctatgcccagaagacctacaacaataagaaggacaagaagagcctgctgaacaatgagaatcggtccaacgagcctgagttctatgagagactgaagcacctgaagatctgcatcatcccactggtgaagtacggcaagttttctaagaagatccaggtgttcaacaattctgtgggatatgccagcaccgaggagggaggaaatctgatcgtgagggagcagtggctggagaaccccagctggcagatcctgatcgaggacgatggctctgccgagtttgagacaatcagccagtatctgttcgataagaaggccaagtttatcccttacctgggcaagaatgaccacttcgccgatatctccgaggtggagaagatcgacctggccgagtccaagaaggataagatcgtgatcaagtctctgttcctggacaacctggccaagcaggtggacgatcccgacgatgagatctcttatctgtttaacgagttctaccctatcggcttcaatgagctgatgttttacaagctggagaagaccaccttcaccaatcagatctgtcaggccatggatggcaagtggtatgagttcaaggacggcaccatctgcttcttttaa

SEQ ID NO: 235 - protein, 240 aa, Campylobacter fetus subsp. testudinum Sp3
  misc_feature (1)..(240): Cas6
MDVKIYQLKVFLKLNQNVDFINSPEFLSTNLHKAMLGDEALRSIHMQRYLKPYSIGFLYSMKGKKDTFVSGEDMYFYVRSIDESFISKLRICLENSKNLGFNVYLSKFENLDIKQVDRLYTMSPATIVLKEGDKTIPWRRENSDITVLKEALISNLKNKYEYFLDKKIEIKDDIIELIEIKTNRAFAFRYKNGKIYAYRYQIHFSQNRLAQEFANIAMILGVGVKNTLGFGFCMRSNNAV

SEQ ID NO: 236 - protein, 563 aa, Campylobacter fetus subsp. testudinum Sp3
  misc_feature (1)..(563): Cas8
MLFELLDEFKKQLEKNKHIVTQNHILKDGVYARISDEKCEIFYVKTITEKIGKTAQKRTILYKQNGDIALNDDMQWFEQADYLSFLWDMNKAVLPNKKFHSINFLSLFFKLEESEYVKENLEEYFDIFRDYSAFNKAKDKEILSFYMDYIKDENRQNLITNSVVLSKKYFNDINDFAVQNNFKKCYIKFFIDKDFEIYEKESQIYIDLKIYNSNEHNIKYNNEIFGLSNFNMGMNSKKPFLEHKNRLFKIPYAISQKDALASKMLFDWLGSQNKRIIRDFNSIFISKFNKQSKAVVSDFEYVPVDKNKFKFDKFKLKNFMNIENGEKEILSFDDFKQVIDEQLYHKCLFGNLYNDEIRVSKRISEDMQNLLYQTRCSMVEYFDKFNNNEFYYVIQKYSNDFIKIAMQDSEFGRLNGKKSINLLLSIKEIKGEKVDIDGIKNRVISALTDDNVTKLSGNEYYFLVGNLAMYLVSKSKTWKKTFALTDPYTKARNTKKLKMALFIDFDRYNYDIFLENGILKKAFSLAQNCEDIVMSNNDQQMVLIGMMTKNIIKKPGEKDEISE

SEQ ID NO: 237 - protein, 313 aa, Campylobacter fetus subsp. testudinum Sp3
  misc_feature (1)..(313): Cas7
MKLANRIYGIIGIKSTMANWNADFSGRPKSTGNGDIFASDKALKYPMKKMWESYGKNILFVKSLKQGKSKDGNDKLVPNTLGERYGLLFGDIKKAKSTKEVLSNLFNCIDVKNFGATFPEDGYNLSITGAVQIGQGFNKFGDINIEVQNILSPFADSRAKEKNENGEDASQSTLGTKIVTDEAHYFYGFCINPLAYNDYKEILGDDFGYNEDDYAEFKKAARFCATYFNSNSKFGCENEFAMFIETAVDAYLPDLSSYMDFICKDKNRLVNLEKIEKMIESSDVKKVEIYYNPLSLDVETKFDKFDIYSGNKI

SEQ ID NO: 238 - protein, 253 aa, Campylobacter fetus subsp. testudinum Sp3
  misc_feature (1)..(253): Cas5
MKAISFKLSGKFAHFKKPDVNEYVYFTYNNIPKPTLLGLLGAIIGLKGYAQKTYNNKKDKKSLLNNENRSNEPEFYERLKHLKICIIPLVKYGKFSKKIQVFNNSVGYASTEEGGNLIVREQWLENPSWQILIEDDGSAEFETISQYLFDKKAKFIPYLGKNDHFADISEVEKIDLAESKKDKIVIKSLFLDNLAKQVDDPDDEISYLFNEFYPIGFNELMFYKLEKTTFTNQICQAMDGKWYEFKDGTICFF

SEQ ID NO: 239 - DNA, 95 bp, Campylobacter fetus subsp. testudinum Sp3
  misc_feature (1)..(95): CRISPR
gtttgctaatgacaatatttgtgttaaaacaagcgtagcaccaaaagaagcgtatgaaagcataggtttgctaatgacaatatttgtgttaaaac

SEQ ID NO: 240 - DNA, 771 bp, Odoribacter splanchnicus DSM 20712
  misc_feature (1)..(771): Cas6
atgcgtttgaaattggtacttaaaattgtggaaggaaccgttttaccttgtaattatatgtatgaattgtcaagttgtttgtacaaggtattgaatgaaggtaatccggtttttactgcctggctacatgataaaggatattgtaaggaaaagaaagcatttaaattatttaccttttcgaatttctattttccgtgtttcagaatcgagggggatcggatttttgttttggcggatacggcccagttgattgtgtcgttctatccgatagaagcaattgatgcttttgtaatgggtctgtttaagaacaggcaattggaggttggtgaccggaaatcgagggtccgctttgaagtctttaacttagagcggcaggctgagccggaattcacttcccggatgttttttaaaactctatcgcctatgtttattgaagagcaattaccggaaacccggaaagcgatacatctttcaccggggaatccgaagtttgcagaattgttgcatttgaatctgctggataaatacagggtgttttatggacaggaacccgatccgtcctggcctctgacccgcttgcatttgttgtctgagcccaagcctaaaacaattgtgctgaaggtaggtactccggaggaaaccagaatgaaaggatatactttccgctttgagctggaaggacagccggaattattgcgtctgggttacgaaggtggtttcggacgattgaacagccagggattcggttgtgtggaagtgttgaaacagtga

SEQ ID NO: 241 - DNA, 1845 bp, Odoribacter splanchnicus DSM 20712
  misc_feature (1)..(1845): Cas8
atgcttcaggaaattaataactttatgaatagtttgcctgctgagttaaagcaggcggggctgaagcctaaagaaggactgcatgttttgctgaaaatccaggaaaaggagggaactcattttatggacgaacagtctgtctgccgggtttgtctgacccggaaagcgacagaattcgattatccttttttacagcattgtgctgagctggctcaggtgggatggtgtgtgaataccaataaatgtttcgatcttccggctaaggggctgcattcctgttctccttattgcattgccttgaaacgggaatctctggaaggaggaggaaaatatgcgaaagataagactaaaatctacgaccgtatcgatacttattttgctaatgctttatcctacgtcgaagaggatagcgagaaagaaagaataagggtttttcagcattttatcaactccaaagagaaactgaatgctttatttgcctgttttcagtcagaggttgatgaagtcaaggataaggagtacattattctttatttggaggaggagatggaaaaatatcgccgggttcatgaaaaatatttgtcggacaaattattcaataccaatgaatacaatatttcggtagaaaatcaactctatgggaccagcgatttcctgaatggatttccaactaaaaagccttttttatcccatcagtcggctgttttcgatattgccgggcggattaccggagagatggctggaaatctccatgattttcaggaaatcatgcgccggaatgttttaccccgtcctttgccgttgtttgtttaccgggaagagttgcagaccgaaatgcttgcggttttctcccggtatttggcggatggcaagaggatcggttatcaggagatcatacgggagctttataaaaatcatcaggacgatatcggtgattattatttattgtattactatggcgatacggtttgtgatttcgattttgtttcccgtttccgctatcgtttgcagagtggggataaagaaggttggatggtaaaagatcattttcagatcggttttacggagaaaataagccatgtatttgagttggaggaaaaagtgttacgcgaaatatttaataactcgttgattacacgaacgaaagccggagatacacaacgtaaatatttcgatgaattagaaccgaaatactgtaaatcggaaaataactatttattggtattgaagtatcggcaagctttttatgattatatctataaatccagattacaggctgttacccgtcctatgttcgatcatattttattgaccggtattttggaggatatccgtttggatgaattaaaaggaaaccagcatacccaacgctgggggattttgtctaaaatgaacatttggttcagtttggctgaacgttttgatttacaatttaaaaatacagatactatggcaagtaaattggaagaacagagagtgtttatggttgccttatcgcaaggtgaggctatattggaaaacgacgaacaatatgcttttgcagccggacaggtgatttactatttattacataagagtaagacggcagacaaaagttataaacggctggagccttttttgcagcaggtgcacgcctctgaattgaataaagcgattgcccggcttttcgatacctataagcatgagaatttttcaggcaatttccgtcatccgtttgcatcggttatggcctatcagacccaagcgaatatgcgggactacctgcccatgatgctggccgggattttttcggataatctgctttttagcgttaataaatcagaagaaacaaatgaagaaaactaa

SEQ ID NO: 242 - DNA, 939 bp, Odoribacter splanchnicus DSM 20712
  misc_feature (1)..(939): Cas7
atgagtaatacatttaaaaacagagtgtttggttgtgtggtaatcaaatctgtcaattccaattataatgcggacttttcacatcagccccgtactttgcccgatgggtcggtatatgcaacagataaagcattgaaatataccgttcggaattatatagataaaaattatccggaagacaaggtattttattttaaaagcctgaatggagatatgcagccccgggatttagaccagaattatgcccgtttcttcggcgattatccgaaagcggataagaaagaggcggtcaaggcgcgtaaagtgattctgggaaatttgttgagctgtctggatgtacggttatttggcggaacttttgccagtaaaacggccaatttgtctattcatggtgttgtacaaccgacgcatggggtgaaccgatatgtggaagggattatctattcagagcagattgcttcgcctttccggaactccaatgataatagtacggattcgatgcaaacgactttaggaacccaatttaaattacaggaaggccattacgtacatcatttttcagtcaatcccggtaatttagacgaactgactgaatttgtcgataatggaagattaacgggggaggatattgccaaattgaaagaagctttacgttgcggagtgacatattatgattcctcttccaaggcaggaacggagaatgaggccttgttgtgggtggaattgaaagaagagtcgaagctggtattaccctctttcgtggatttgatagaggtaaatgcagaacgggaaattgattttgcgaaagtgagtaccttattgtccaaagaaaaaatcaaaaatgagatctcaaaaattgaattgttttacaataagggaattacaaaagtgattcatctgccggaaggaacggtcgaacttgaattgaacgggttatga

SEQ ID NO: 243 - DNA, 780 bp, Odoribacter splanchnicus DSM 20712
  misc_feature (1)..(780): Cas5
atgaataatcaacgactgatttcatttgatatacaggctgatttcggtttcttcaaaaagcccgattacaatgatggggtgttgctgacctataatatgttacataagcccgccctgttaggcatattgggggctattatcggtttgcggggttatcggaaaaaaggagaatggccggaatattaccagcggttggctgccctcccggtgggaatagaacctttggaggggagacatgagaaagggaattttcagaaaacgatagtcaagtatacgaatacggtcggatatgctaatcaggatggtaacctgctggttgaagagagtatgctgattcgtccggcctatcgctgctatcttttgttgtcggaagagcatccggatcaccggaagttgtacgagtatatccgggaaggatgggccgagtatattccctatttgggtaaaaatgaatatccggcctggttcggagattcgttccgggaatatgcttttaaaacttttgtaccggaaactgatttccgggtttcatccttgtttatcaaagaaggagtattgaaaggacagcaggtaaaggccagtttttcgttttcgctgaaaggcatagtgaatcgaggtagttttgtgtatttcgaacgtttgcctgttggttttcatccggttctgatgcaatatgaattggccgacttcgcttttacggattggaccttacaggctgccacgcagatggtaaatttgtatcagctggaagaggaaggaaagattgttcaattgttttga

SEQ ID NO: 244 - DNA, 771 bp, Odoribacter splanchnicus DSM 20712
  misc_feature (1)..(771): Cas6
atgaggctgaagctggtgctgaagatcgtggagggcacagtgctgccctgcaactatatgtacgagctgagctcctgtctgtacaaggtgctgaacgagggcaatcccgtgttcaccgcctggctgcacgataagggctattgcaaggagaagaaggcctttaagctgttcacattttccaatttctactttccatgtttcagaatcgagggcgacaggatctttgtgctggccgataccgcccagctgatcgtgtctttctaccccatcgaggccatcgacgccttcgtgatgggcctgtttaagaaccgccagctggaagtgggcgatcggaagtccagggtgcgctttgaggtgttcaatctggagaggcaggcagagcctgagttcaccagccggatgttctttaagacactgtccccaatgtttatcgaggagcagctgcccgagacaagaaaggccatccacctgtctcctggcaacccaaagttcgccgagctgctgcacctgaatctgctggacaagtacagagtgttttatggccaggagcccgatcctagctggccactgaccaggctgcacctgctgtccgagccaaagcccaagacaatcgtgctgaaggtcggcacccccgaggagacaagaatgaagggctataccttcaggtttgagctggagggccagcctgagctgctgagactgggatacgagggaggattcggcaggctgaacagccagggctttggctgcgtggaggtgctgaagcagtaa

SEQ ID NO: 245 - DNA, 1845 bp, Odoribacter splanchnicus DSM 20712
  misc_feature (1)..(1845): Cas8
atgctgcaggagatcaacaatttcatgaattctctgccagcagagctgaagcaggcaggcctgaagccaaaggagggactgcacgtgctgctgaagatccaggagaaggagggcacccactttatggacgagcagtccgtgtgccgggtgtgcctgacccggaaggcaacagagtttgattaccccttcctgcagcactgcgcagagctggcccaagtgggatggtgcgtgaacacaaataagtgtttcgacctgcctgccaagggcctgcactcttgcagcccatattgtatcgccctgaagagagagagcctggagggaggcggcaagtacgcaaaggacaagaccaagatctatgacaggatcgatacatactttgccaacgccctgagctacgtggaggaggattccgagaaggagcggatcagagtgtttcagcacttcatcaactccaaggagaagctgaatgccctgtttgcctgtttccagtctgaggtggacgaggtgaaggataaggagtacatcatcctgtatctggaggaggagatggagaagtataggcgcgtgcacgagaagtacctgtccgacaagctgttcaacaccaatgagtataacatcagcgtggagaatcagctgtacggcacctccgattttctgaacggcttcccaacaaagaagcccttcctgagccaccagtccgccgtgtttgacatcgcaggaaggatcaccggagagatggcaggcaacctgcacgattttcaggagatcatgcggagaaatgtgctgcctcgcccactgcccctgttcgtgtatcgggaggagctgcagacagagatgctggccgtgtttagcagatacctggccgacggcaagaggatcggctatcaggagatcatccgcgagctgtacaagaaccaccaggacgatatcggcgactactatctgctgtactattacggcgataccgtgtgcgactttgatttcgtgtctaggttccgctacaggctgcagagcggcgacaaggagggatggatggtgaaggatcactttcagatcggcttcaccgagaagatcagccacgtgttcgagctggaggagaaggtgctgcgggagatctttaacaattccctgatcaccagaacaaaggccggcgacacacagaggaagtatttcgatgagctggagcccaagtactgtaagtctgagaacaattatctgctggtgctgaagtacagacaggccttctatgactacatctataagagccgcctgcaggcagtgacccggcctatgtttgatcacatcctgctgacaggcatcctggaggacatcagactggatgagctgaagggcaaccagcacacccagaggtggggcatcctgtccaagatgaatatctggttctctctggccgagcggttcgacctgcagttcaagaacaccgatacaatggccagcaagctggaggagcagcgggtgttcatggtggccctgtcccagggagaggcaatcctggagaatgacgagcagtacgcctttgccgccggccaggtcatctactacctgctgcacaagtctaagaccgccgataagagctataagaggctggagcccttcctgcagcaggtgcacgcctccgagctgaacaaggccatcgcccgcctgtttgacacctacaagcacgagaacttttctggcaatttccggcacccatttgccagcgtgatggcctatcagacacaggccaatatgcgcgactacctgcccatgatgctggccggcatcttcagcgataacctgctgttttccgtgaataagtctgaggagaccaacgaggagaattaa

SEQ ID NO: 246 - DNA, 939 bp, Odoribacter splanchnicus DSM 20712
  misc_feature (1)..(939): Cas7
atgtctaacaccttcaagaatcgggtgtttggctgcgtggtcatcaagagcgtgaactccaattataacgccgacttctcccaccagccacgcacactgcctgacggcagcgtgtacgccaccgataaggccctgaagtacacagtgcggaactatatcgacaagaattaccctgaggataaggtgttctactttaagtctctgaacggcgacatgcagccacgcgacctggatcagaattatgcccggttctttggcgactaccccaaggccgataagaaggaggccgtgaaggccagaaaagtgatcctgggcaacctgctgagctgtctggatgtgaggctgtttggcggcaccttcgcctctaagacagccaacctgagcatccacggagtggtgcagcctacccacggagtgaatagatatgtggagggcatcatctacagcgagcagatcgcctccccattcaggaattctaacgacaattctaccgatagcatgcagaccacactgggcacacagttcaagctgcaggagggccactacgtgcaccactttagcgtgaacccaggcaatctggacgagctgaccgagtttgtggataacggccgcctgacaggcgaggacatcgcaaagctgaaggaggccctgagatgcggagtgacctactatgatagctcctctaaggccggcacagagaacgaggccctgctgtgggtggagctgaaggaggagtccaagctggtgctgccctctttcgtggacctgatcgaagtgaatgccgagcgggagatcgattttgccaaggtgtctaccctgctgagcaaggagaagatcaagaacgagatctccaagatcgagctgttctacaataagggcatcaccaaagtgatccacctgcctgagggcacagtggagctggagctgaacggactgtaa

SEQ ID NO: 247 - DNA, 780 bp, Odoribacter splanchnicus DSM 20712
  misc_feature (1)..(780): Cas5
atgaacaatcagcggctgatctctttcgacatccaggccgattttggcttctttaagaagcctgactataacgatggcgtgctgctgacctacaatatgctgcacaagccagccctgctgggcatcctgggagccatcatcggcctgagaggctacaggaagaagggcgagtggcccgagtactatcagagactggccgccctgcctgtgggaatcgagccactggagggcaggcacgagaagggcaacttccagaagacaatcgtgaagtataccaatacagtgggctacgccaaccaggacggcaatctgctggtggaggagtctatgctgatccgccctgcctaccggtgctatctgctgctgagcgaggagcacccagatcaccgcaagctgtatgagtacatccgggagggctgggccgagtacatcccttatctgggcaagaacgagtatccagcctggtttggcgactccttccgcgagtacgcctttaagaccttcgtgcctgagacagatttccgggtgtctagcctgtttatcaaggagggcgtgctgaagggccagcaggtgaaggcctccttctcttttagcctgaagggcatcgtgaatagaggcagcttcgtgtacttcgagaggctgcccgtgggcttccaccctgtgctgatgcagtacgagctggccgacttcgcctttaccgattggacactgcaggccgccacccagatggtgaacctgtaccagctggaggaggagggcaagatcgtgcagctgttttaa

SEQ ID NO: 248 - protein, 256 aa, Odoribacter splanchnicus DSM 20712
  misc_feature (1)..(256): Cas6
MRLKLVLKIVEGTVLPCNYMYELSSCLYKVLNEGNPVFTAWLHDKGYCKEKKAFKLFTFSNFYFPCFRIEGDRIFVLADTAQLIVSFYPIEAIDAFVMGLFKNRQLEVGDRKSRVRFEVFNLERQAEPEFTSRMFFKTLSPMFIEEQLPETRKAIHLSPGNPKFAELLHLNLLDKYRVFYGQEPDPSWPLTRLHLLSEPKPKTIVLKVGTPEETRMKGYTFRFELEGQPELLRLGYEGGFGRLNSQGFGCVEVLKQ

SEQ ID NO: 249 - protein, 614 aa, Odoribacter splanchnicus DSM 20712
  misc_feature (1)..(614): Cas8
MLQEINNFMNSLPAELKQAGLKPKEGLHVLLKIQEKEGTHFMDEQSVCRVCLTRKATEFDYPFLQHCAELAQVGWCVNTNKCFDLPAKGLHSCSPYCIALKRESLEGGGKYAKDKTKIYDRIDTYFANALSYVEEDSEKERIRVFQHFINSKEKLNALFACFQSEVDEVKDKEYIILYLEEEMEKYRRVHEKYLSDKLFNTNEYNISVENQLYGTSDFLNGFPTKKPFLSHQSAVFDIAGRITGEMAGNLHDFQEIMRRNVLPRPLPLFVYREELQTEMLAVFSRYLADGKRIGYQEIIRELYKNHQDDIGDYYLLYYYGDTVCDFDFVSRFRYRLQSGDKEGWMVKDHFQIGFTEKISHVFELEEKVLREIFNNSLITRTKAGDTQRKYFDELEPKYCKSENNYLLVLKYRQAFYDYIYKSRLQAVTRPMFDHILLTGILEDIRLDELKGNQHTQRWGILSKMNIWFSLAERFDLQFKNTDTMASKLEEQRVFMVALSQGEAILENDEQYAFAAGQVIYYLLHKSKTADKSYKRLEPFLQQVHASELNKAIARLFDTYKHENFSGNFRHPFASVMAYQTQANMRDYLPMMLAGIFSDNLLFSVNKSEETNEEN

SEQ ID NO: 250 - protein, 312 aa, Odoribacter splanchnicus DSM 20712
  misc_feature (1)..(312): Cas7
MSNTFKNRVFGCVVIKSVNSNYNADFSHQPRTLPDGSVYATDKALKYTVRNYIDKNYPEDKVFYFKSLNGDMQPRDLDQNYARFFGDYPKADKKEAVKARKVILGNLLSCLDVRLFGGTFASKTANLSIHGVVQPTHGVNRYVEGIIYSEQIASPFRNSNDNSTDSMQTTLGTQFKLQEGHYVHHFSVNPGNLDELTEFVDNGRLTGEDIAKLKEALRCGVTYYDSSSKAGTENEALLWVELKEESKLVLPSFVDLIEVNAEREIDFAKVSTLLSKEKIKNEISKIELFYNKGITKVIHLPEGTVELELNGL

SEQ ID NO: 251 - protein, 259 aa, Odoribacter splanchnicus DSM 20712
  misc_feature (1)..(259): Cas5
MNNQRLISFDIQADFGFFKKPDYNDGVLLTYNMLHKPALLGILGAIIGLRGYRKKGEWPEYYQRLAALPVGIEPLEGRHEKGNFQKTIVKYTNTVGYANQDGNLLVEESMLIRPAYRCYLLLSEEHPDHRKLYEYIREGWAEYIPYLGKNEYPAWFGDSFREYAFKTFVPETDFRVSSLFIKEGVLKGQQVKASFSFSLKGIVNRGSFVYFERLPVGFHPVLMQYELADFAFTDWTLQAATQMVNLYQLEEEGKIVQLF

SEQ ID NO: 252 - DNA, 97 bp, Odoribacter splanchnicus DSM 20712
  misc_feature (1)..(97): CRISPR
cttttaattgaactaaggtagaattgaaactaggaataaaccgtacccaaccacgtagccatatacgcttttaattgaactaaggtagaattgaaac

SEQ ID NO: 253 - DNA, 711 bp, Bacillus halodurans C-125
  misc_feature (1)..(711): Cas5
atgagaaacgaagtccaatttgagctatttggagactacgcgctttttaccgatccgctcacgaagattggtggggagaagctttcctacagtgtccctacctatcaagcgttgaaaggaattgccgaaagcatctactggaagccgacgattgtctttgttatcgatgagcttcgggtgatgaagccgattcagatggagtctaaaggggtgcgtccgattgaatatggcgggggtaatacgcttgcccattatacgtatttaaaagatgtgcattatcaggtaaaggcccattttgaattcaatcttcaccgacctgacttggcgtttgaccgcaatgaagggaagcattacagcattcttcagcgttctttgaaagctggggggcggagagatatttttcttggggcgagagagtgccaaggatatgtagctccgtgtgagtttgggagtggcgacggtttttatgatggacaagggaagtatcatttaggaacgatggttcatggatttaactatcctgatgagacgggtcaacatcagcttgatgtgcgtttatggtctgctgtaatggagaatgggtacatccaatttccaaggcccgaagactgtccgattgtccgacctgtgaaagagatggagcccaaaatctttaatccagacaatgttcaatctgccgagcaattactccatgacttaggaggtgagtga

SEQ ID NO: 254 - DNA, 1884 bp, Bacillus halodurans C-125
  misc_feature (1)..(1884): Cas8
atgagttggttgcttcacctatacgaaacctatgaagccaatctcgatcaggttgggaaaacggtgaaaaagggagaggatcgagaatacacattgctgccgatctcccatacgacccaaaatgctcatatcgaagtaacacttgacgaagatggcgactttctaagagcaaaagcattaacgaaagagagcacgttaatcccttgtacagaagaggctgccagtcgctcaggttcaaaggttgcaccgtaccctcttcacgataagcttagctatgttgctggtgattttgtcaaatacggaggaaagatcaaaaatcaagacgatgctccttttgacacctatataaaaaatttaggtgagtgggccaattccccgtatgcgacggagaaggtgaagtgcatttatacgtatttgaaaaaagggcgattgattgaagacttggtcgacgcaggtgtccttaagctcgatgaaaaccaacaattgatcgaaaaatgggaaaagcgatatgaagagctactgggggaaaagcccgctattttttcaagtggtgctaccgatcaagcgagtgcttttgtgagattcaatgtttttcaccctgagtcgatcgacgatgtttggaaagacaaagagatgtttgattcatttatttctttttataatgacaaattaggcgaagaggatatttgtttcgtcacagggaacaggcttcctagcacagaacgccatgcaaataagatccgtcatgcggcggataaggcaaaattaatatcagctaatgataactctggttttaccttccgtgggcgatttaaaacaagtcgagaagccgtgggcattagctatgaggtttctcaaaaggcccataatgctttgaaatggctcattcatcgccaaagtaaaagcattgatgatcgtgtgtttcttgtttggagtaatgataacagtcttgtgcctaacccagatgaggatgcggtagacatcatgaagcatgccaaccgtgagttagaaagagatccagatacagggcaaatttttgcaggtgaagttaagaaagcgatcggcggctatcggagtgacttgaactatcaaccagaggttcatattctcgttcttgattcagcaacgactgggagaatggccgttctttattatcgaagtctcaataaagaactctatttgaatcgtttagaggcgtggcatgattcgtgtgcatgggagcaccggtatcgaagggacgaaaaggagtttatttcgttttatggggcacctgcaacgaaggatattgcatttgccgcttatggaccgagagcgagtgaaaaggtcataaaagacttaatggaacgaatgcttccttgtattgtcgatgggcgtcgggtcccaaaggatattgttagaagtgccttccaacgggcttcaaatccggtctcgatggagcgctgggaatgggaaaaaacattaagtatcacatgtgcccttattagaaaaatgcacattgaacaaaaggaggaatggggcgtgccacttgataaaagctcaacggaccgcagctacttgtttggacgcttgctggctgttgctgatgtgttggagcgaggggctctcggtaaggacgaaacaagagctaccaatgctattcgttatatgaactcatattcaaaaaatccaggacgtacgtggaaaacgattcaggaaagcttgcagccgtaccaagccaaactcggaactaaagcgacttatttatcaaagctagtcgacgagatcggcgatcaatttgagccaggggactttaacaacaaccctctgacggaacaatatttgcttgggttttatagtcaacgtcgtgagctttataagaaaaaagaggaggagaccaaccaatga

SEQ ID NO: 255 - DNA, 852 bp, Bacillus halodurans C-125
  misc_feature (1)..(852): Cas7
atgactatacttgaccacaaaattgattttgctgttattctatctgttactaaagccaatccgaatggagatccccttaacggaaaccgcccacgtcaaaattacgatgggcatggggagatttctgatgttgcgatcaagcgtaaaattcgcaatcgtttgctagatatggaagaacctatttttgttcaatctgatgaccgtaaagcagattcttttaaaagtttgcgagatcgtgcagattcgaatcctgagttagccaaaatgctgaaagcaaaaaatgcgtctgttgatgaatttgcaaaaattgcttgtcaagagtggatggatgtgcgtagttttggacaagtatttgcgtttaaaggctccaatttatccgttggtgttcgcggtcctgtgtcgattcacacagcaacgagcattgatcctattgatattgttagcacccagattacaaaaagtgttaactcggtcacgggtgataaacgtagctcagacaccatgggaatgaagcaccgtgtcgactttggtgtttatgtgttcaaagggagcattaacacgcagcttgcagagaaaacaggctttacgaatgaagatgcggaaaaaatcaagcgggcactcatcaccctgtttgaaaatgacagctcttccgcccgccctgatgggagcatggaggtccataaagtgtactggtgggagcattcttcaaagcttggacaatattcttctgccaaagtgcatcgttcattaaaaattgaatcaaagacggatacacctaagagttttgatgattatgccgttgaactatatgaattagatggcttgggtgttgaagtgattgatggccagtaa

SEQ ID NO: 256 - DNA, 711 bp, Bacillus halodurans C-125
  misc_feature (1)..(711): Cas5
atgcggaacgaggtgcagtttgagctgttcggcgattacgccctgtttaccgaccccctgacaaagatcggcggcgagaagctgtcctactctgtgcctacctatcaggccctgaagggcatcgccgagtccatctattggaagccaacaatcgtgttcgtgatcgatgagctgagagtgatgaagcccatccagatggagtctaagggcgtgaggcctatcgagtatggcggcggcaacaccctggcccactacacatatctgaaggacgtgcactaccaggtgaaggcccacttcgagtttaatctgcacagacccgatctggcctttgacaggaacgagggcaagcactactctatcctgcagcgcagcctgaaggcaggaggccggagagacatcttcctgggagcaagggagtgccagggatatgtggccccttgtgagtttggctctggcgatggcttctacgacggccagggcaagtatcacctgggcaccatggtgcacggcttcaattacccagatgagacaggccagcaccagctggacgtgaggctgtggtccgccgtgatggagaacggctatatccagtttcctagaccagaggattgccccatcgtgaggcctgtgaaggagatggagccaaagatcttcaatcccgataacgtgcagagcgccgagcagctgctgcacgacctgggaggagagtaa

SEQ ID NO: 257 - DNA, 1884 bp, Bacillus halodurans C-125
  misc_feature (1)..(1884): Cas8
atgagctggctgctgcacctgtacgagacatatgaggccaatctggatcaagtgggcaagaccgtgaagaagggcgaggacagagagtacacactgctgccaatctcccacaccacacagaacgcccacatcgaggtgaccctggacgaggatggcgacttcctgagggccaaggccctgaccaaggagtctacactgatcccatgcacagaggaggcagcctcccgctctggcagcaaggtggcaccataccctctgcacgataagctgagctatgtggccggcgactttgtgaagtacggcggcaagatcaagaatcaggacgatgccccattcgacacctatatcaagaatctgggagagtgggcaaacagcccatacgcaaccgagaaggtgaagtgtatctacacatatctgaagaagggccgcctgatcgaggatctggtggacgccggcgtgctgaagctggatgagaaccagcagctgatcgagaagtgggagaagcggtacgaggagctgctgggcgagaagcctgccatctttagctccggcgcaaccgaccaggccagcgccttcgtgcggttcaacgtgttccacccagagtccatcgacgacgtgtggaaggataaggagatgttcgactcctttatctctttctataacgataagctgggcgaggaggacatctgcttcgtgaccggcaatcggctgcccagcacagagagacacgccaacaagatcaggcacgccgccgataaggccaagctgatcagcgccaatgacaactccggctttaccttccggggccggttcaagaccagccgggaggcagtgggaatcagctacgaggtgtcccagaaggcccacaatgccctgaagtggctgatccaccgccagtccaagtctatcgacgatcgggtgttcctggtgtggtctaatgataacagcctggtgccaaatcccgatgaggacgccgtggacatcatgaagcacgccaacagggagctggagcgcgatccagacaccggacagatcttcgcaggagaggtgaagaaggcaatcggaggctaccgcagcgatctgaactatcagcccgaggtgcacatcctggtgctggactctgccaccacaggccgcatggccgtgctgtactatcggagcctgaataaggagctgtacctgaaccgcctggaggcctggcacgattcttgtgcctgggagcaccggtatcggagagacgagaaggagtttatcagcttctacggcgcccccgccaccaaggatatcgcctttgccgcatatggacctagggcctccgagaaagtgatcaaggacctgatggagcggatgctgccttgcatcgtggatggcaggcgcgtgccaaaggacatcgtgcggagcgccttccagagagcctccaatcccgtgtctatggagagatgggagtgggagaagaccctgtccatcacatgtgccctgatcaggaagatgcacatcgagcagaaggaggagtggggcgtgcctctggataagtctagcaccgaccgcagctacctgtttggccggctgctggccgtggcagatgtgctggagaggggcgccctgggcaaggacgagaccagagccacaaacgccatcaggtacatgaatagctattccaagaaccctggccgcacctggaagacaatccaggagtccctgcagccatatcaggccaagctgggcaccaaggccacatacctgtctaagctggtggatgagatcggcgaccagtttgagcctggcgacttcaacaataacccactgaccgagcagtacctgctgggcttctatagccagcggagagagctgtacaagaagaaggaggaggagacaaaccagtaa

SEQ ID NO: 258 - DNA, 852 bp, Bacillus halodurans C-125
  misc_feature (1)..(852): Cas7
atgaccatcctggatcacaagatcgacttcgccgtgatcctgtccgtgacaaaggccaatcctaacggcgacccactgaatggcaacaggcctcgccagaattacgatggccacggcgagatctctgacgtggccatcaagagaaagatcagaaacagactgctggatatggaggagcccatctttgtgcagagcgacgataggaaggccgactctttcaagagcctgagggatcgcgccgactccaatcctgagctggccaagatgctgaaggccaagaacgcctctgtggatgagtttgccaagatcgcctgccaggagtggatggacgtgcgctccttcggccaggtgttcgcctttaagggctccaatctgtctgtgggcgtgcggggacccgtgagcatccacaccgccacaagcatcgatccaatcgacatcgtgtctacccagatcacaaagagcgtgaactccgtgaccggcgataagagaagctccgacacaatgggcatgaagcacagggtggattttggcgtgtacgtgttcaagggctccatcaatacccagctggccgagaagaccggctttacaaacgaggacgccgagaagatcaagagagccctgatcacactgttcgagaacgattctagctccgccaggcctgacggctccatggaggtgcacaaggtgtattggtgggagcactctagcaagctgggccagtactcctctgccaaggtgcaccggagcctgaagatcgagtccaagaccgatacaccaaagagcttcgacgattacgccgtggagctgtatgagctggatggcctgggcgtggaagtgatcgacggacagtaa

SEQ ID NO: 259 - protein, 236 aa, Bacillus halodurans C-125
  misc_feature (1)..(236): Cas5
MRNEVQFELFGDYALFTDPLTKIGGEKLSYSVPTYQALKGIAESIYWKPTIVFVIDELRVMKPIQMESKGVRPIEYGGGNTLAHYTYLKDVHYQVKAHFEFNLHRPDLAFDRNEGKHYSILQRSLKAGGRRDIFLGARECQGYVAPCEFGSGDGFYDGQGKYHLGTMVHGFNYPDETGQHQLDVRLWSAVMENGYIQFPRPEDCPIVRPVKEMEPKIFNPDNVQSAEQLLHDLGGE

SEQ ID NO: 260 - protein, 627 aa, Bacillus halodurans C-125
  misc_feature (1)..(627): Cas8
MSWLLHLYETYEANLDQVGKTVKKGEDREYTLLPISHTTQNAHIEVTLDEDGDFLRAKALTKESTLIPCTEEAASRSGSKVAPYPLHDKLSYVAGDFVKYGGKIKNQDDAPFDTYIKNLGEWANSPYATEKVKCIYTYLKKGRLIEDLVDAGVLKLDENQQLIEKWEKRYEELLGEKPAIFSSGATDQASAFVRFNVFHPESIDDVWKDKEMFDSFISFYNDKLGEEDICFVTGNRLPSTERHANKIRHAADKAKLISANDNSGFTFRGRFKTSREAVGISYEVSQKAHNALKWLIHRQSKSIDDRVFLVWSNDNSLVPNPDEDAVDIMKHANRELERDPDTGQIFAGEVKKAIGGYRSDLNYQPEVHILVLDSATTGRMAVLYYRSLNKELYLNRLEAWHDSCAWEHRYRRDEKEFISFYGAPATKDIAFAAYGPRASEKVIKDLMERMLPCIVDGRRVPKDIVRSAFQRASNPVSMERWEWEKTLSITCALIRKMHIEQKEEWGVPLDKSSTDRSYLFGRLLAVADVLERGALGKDETRATNAIRYMNSYSKNPGRTWKTIQESLQPYQAKLGTKATYLSKLVDEIGDQFEPGDFNNNPLTEQYLLGFYSQRRELYKKKEEETNQ

SEQ ID NO: 261 - protein, 283 aa, Bacillus halodurans C-125
  misc_feature (1)..(283): Cas7
MTILDHKIDFAVILSVTKANPNGDPLNGNRPRQNYDGHGEISDVAIKRKIRNRLLDMEEPIFVQSDDRKADSFKSLRDRADSNPELAKMLKAKNASVDEFAKIACQEWMDVRSFGQVFAFKGSNLSVGVRGPVSIHTATSIDPIDIVSTQITKSVNSVTGDKRSSDTMGMKHRVDFGVYVFKGSINTQLAEKTGFTNEDAEKIKRALITLFENDSSSARPDGSMEVHKVYWWEHSSKLGQYSSAKVHRSLKIESKTDTPKSFDDYAVELYELDGLGVEVIDGQ

SEQ ID NO: 262 - DNA, 99 bp, Bacillus halodurans C-125
  misc_feature (1)..(99): Exemplary minimal CRISPR array
gtcgcactcttcatgggtgcgtggattgaaatcctttgacggagaggggaacaggaaattagagaaggtcgcactcttcatgggtgcgtggattgaaat

SEQ ID NO: 263 - DNA, 684 bp, Desulfovibrio vulgaris
  misc_feature (1)..(684): Cas5, Desulfovibrio vulgaris RCH1 plasmid pDEVAL01
atgacacatggggctgttaagacatacggcatcagactgcgggtatggggcgactacgcctgcttcacgcggccggagatgaaggtggaacgggtgtcatacgatgtcatgcccccttccgccgcacggggcatccttgaggccatccactggaagccggccatcaggtggattgtggacaggattcatgtgctgcggcccatcgtcttcgacaacgtgcggcgcaacgaggtcagttcgaagatacccaagcccaatccggcaacggccatgcgcgacaggaagccgctctactttctggtcgatgacggcagcaaccgccagcaacgggcggcgaccctgctgcgcaacgtcgactatgtcatcgaagcccacttcgaactgacagacaaggccggagcggaagacaacgcgggcaagcatctggacatcttcaggcgtcgtgcgcgcgccgggcagtcgttccagcagccatgcctcggctgccgcgagtttccggcgtcgttcgaactgctggagggggatgtgccgctctcgtgctacgcgggcgagaagcgcgaccttggctacatgctgctcgacatcgacttcgaacgcgacatgacgccgctgttcttcaaggccgtcatggaagacggagtgataacgcccccgtcgcgcacgtcaccggaggtgagggcatga

SEQ ID NO: 264 - DNA, 1839 bp, Desulfovibrio vulgaris
  misc_feature (1)..(1839): Cas8, Desulfovibrio vulgaris RCH1 plasmid pDEVAL01
atgatcctgcaggcattgcatggctattaccagcgcatgagcgcagaccccgatgcggggatgccgccctacgggaccagcatggagaacatctcgttcgcgctggtgctggatgcgaaagggacgctacggggcatcgaggacttgcgggaacaggaaggcaagaagctgcggccccgcaagatgctggttcctatcgcggaaaagaaggggaacggcatcaaaccgaacttcctgtgggagaacaccagttatattctgggggtggacgccaagggcaagcaggaacgtacagacaagtgccacgccgcgttcattgcccacatcaaggcctactgtgacactgcagaccaagaccttgccgccgttctgcagttccttgaacacggcgaaaaagacctctccgcttttccggtttcggaagaggtcatcggctccaatatcgtctttcgcatcgagggcgaaccgggcttcgtccatgagcgtccggctgcgcggcaggcttgggccaactgcctgaaccggcgggagcaagggctatgtggtcaatgcctcatcaccggggagcgccagaagccgattgcccaactccatccgtcgatcaaaggcgggcgagacggcgttcgcggtgcacaggctgttgcctcgatagtgtcctttaacaacaccgcctttgaatcttacgggaaagaacagtcgatcaatgcacccgtcagtcaagaagcggcattctcttatgtcacagccctgaattacctgctcaacccgtcaaatcgacagaaggtcaccatcgctgacgccaccgtggtcttctgggccgaacgcagcagcccggcagaggacatctttgcaggcatgttcgacccgccttccaccacggcgaaaccggagtcctcgaacgggacgccgccggaagacagtgaagaaggcagccagcctgacacagccagagacgacccccatgccgctgccagaatgcacgacctgcttgtggccatccgttccggcaagcgcgccacggacatcatgcccgacatggacgagtccgtgcgcttccatgtgcttggcctgtcgcccaacgccgcccgcctgtccgtccgcttctgggaggtcgataccgtcggtcacatgctggacaaggtggggcggcactaccgtgaactcgagatcattccgcaattcaacaacgagcaggagttcccgtctctttcaaccctgctgcggcagactgccgtcttgaacaagaccgagaacatctcgcctgtacttgcaggcgggctattcagggccatgctcaccggcgggccctatccgcaaagcctgttgcccgccgtgcttggacgcatccgcgccgagcacgccagaccagaagataaaagccgctataggcttgaagttgtgacgtattatcgagccgccttgatcaaggcgtatctcataagaaacagaaagctggaggtgcccgtgtctctcgaccccgcaagaacagaccgcccgtacctgctcggacgactcttcgccgttctggaaaaagcgcaggaagatgccgtgcccggtgcgaacgccaccatcaaggaccgctatctggcctccgcatcggccaatccggggcaggtattccacatgctgctcaagaatgcgtccaaccacacggccaaactccgcaaggaccctgaaagaaaggggtcggccatccactacgaaatcatgatgcaagagattatcgacaacatcagcgattttccggtgaccatgtcgtccgacgaacaaggcctgttcatgatcggctactaccaccagcgcaaggcccttttcaccaagaagaacaaggagaactag

SEQ ID NO: 265 - DNA, 873 bp, Desulfovibrio vulgaris
  misc_feature (1)..(873): Cas7, Desulfovibrio vulgaris RCH1 plasmid pDEVAL01
atgaccgccattgccaacagatacgagttcgtgctgcttttcgatgtggagaacggcaaccccaacggcgaccccgacgcgggcaacatgccgcgcatcgaccccgagaccgggcatggtctggtcaccgacgtgtgcctgaagcgcaagatacgcaaccatgtggccctgacaaaagaaggtgccgagcggttcaatatctatattcaggaaaaggccattctcaacgaaacccacgaacgcgcctacacggcctgcgacctgaaacccgaacccaagaaactgcccaagaaggtcgaagacgccaagagggtcaccgactggatgtgcacgaacttctacgacatccgcacgttcggcgccgtcatgaccacagaggtcaactgcgggcaggtgcgcggccccgtgcagatggcctttgccagaagtgtggaacccgtcgtgccgcaagaggtgagcatcacccgcatggcagtcaccacgaaggcagaggccgaaaagcagcagggagacaaccgcaccatgggtcgcaagcacatcgtgccctacggcctgtatgtggcgcacggcttcatctccgcaccgctggcagagaagacaggcttctccgatgaagacctgacgctgttctgggacgccctcgtcaacatgttcgagcacgaccgttcggcggcacgcggcctcatgagcagccgcaaactcatcgtcttcaagcaccagaacaggctcggcaacgcccccgcccacaagttgttcgacctcgtgaaggtcagccgtgcagagggttcgtccggccccgcccggtcgtttgccgactatgcggtgacagtggggcaggcccccgaaggcgtagaggtcaaagagatgctgtag

SEQ ID NO: 266 - DNA, 684 bp, Desulfovibrio vulgaris
  misc_feature (1)..(684): Cas5, Desulfovibrio vulgaris RCH1 plasmid pDEVAL01
atgacccacggagcagtgaagacatacggcatcagactgagggtgtggggcgactatgcctgttttacccggcctgagatgaaggtggagagagtgagctacgatgtgatgccaccatccgccgcaaggggcatcctggaggcaatccactggaagccagccatcagatggatcgtggacagaatccacgtgctgcgccccatcgtgttcgataatgtgcggagaaacgaggtgtcctctaagatccctaagccaaacccagcaacagcaatgagggataggaagcccctgtattttctggtggacgatggctccaacaggcagcagagggcagccaccctgctgcggaatgtggactacgtgatcgaggcccacttcgagctgacagacaaggccggcgccgaggataatgccggcaagcacctggatatcttcaggcgccgggcaagggcaggacagagctttcagcagccttgcctgggctgtcgcgagtttccagcctccttcgagctgctggagggcgacgtgccactgtcttgctacgcaggcgagaagcgggatctgggctatatgctgctggacatcgatttcgagagagacatgaccccactgttctttaaggccgtgatggaggatggcgtgatcacccctccatctaggacaagccccgaggtgcgcgcataa

SEQ ID NO: 267 - DNA, 1839 bp, Desulfovibrio vulgaris
  misc_feature (1)..(1839): Cas8, Desulfovibrio vulgaris RCH1 plasmid pDEVAL01
atgatcctgcaggccctgcacggatactatcagagaatgtccgccgaccctgatgcaggaatgccaccctacggcaccagcatggagaatatctccttcgccctggtgctggacgccaagggcacactgaggggcatcgaggatctgcgcgagcaggagggcaagaagctgagaccaaggaagatgctggtgcccatcgccgagaagaagggcaatggcatcaagccaaactttctgtgggagaataccagctatatcctgggcgtggacgccaagggcaagcaggagaggaccgataagtgccacgccgccttcatcgcccacatcaaggcctactgtgacaccgcagaccaggatctggcagccgtgctgcagttcctggagcacggcgagaaggatctgtctgcctttcccgtgagcgaggaagtgatcggctccaacatcgtgttcagaatcgagggcgagcccggctttgtgcacgagagacctgcagcaaggcaggcctgggccaattgtctgaacaggagggagcagggactgtgcggacagtgtctgatcaccggcgagaggcagaagcctatcgcccagctgcacccaagcatcaagggaggaagggacggcgtgcggggagcacaggccgtggccagcatcgtgtcctttaacaataccgccttcgagtcttacggcaaggagcagagcatcaacgcacccgtgtcccaggaggcagccttttcttacgtgacagccctgaattatctgctgaatccttccaacaggcagaaggtgaccatcgccgatgccacagtggtgttctgggcagagcgcagctccccagcagaggacatctttgccggcatgttcgatcctccatctaccacagccaagcccgagtctagcaacggaaccccccctgaggactctgaggagggcagccagccagatacagcaagggacgatccacacgcagcagcaaggatgcacgacctgctggtggccatcagatctggcaagagggccaccgatatcatgcccgacatggatgagagcgtgagatttcacgtgctgggcctgtctcctaatgcagcaaggctgagcgtgcggttctgggaggtggacacagtgggccacatgctggataaagtgggcagacactatagggagctggagatcatccctcagtttaacaatgagcaggagttcccatccctgtctaccctgctgagacagacagccgtgctgaataagaccgagaacatctctccagtgctggccggaggactgttcagggcaatgctgacaggaggaccttacccacagagcctgctgccagccgtgctgggacgcatccgggcagagcacgcacggcctgaggacaagtccagatacaggctggaggtggtgacctactatagagccgccctgatcaaggcctatctgatccgcaaccggaagctggaggtgcccgtgtccctggaccctgcaaggaccgataggccatatctgctgggccgcctgtttgccgtgctggagaaggcacaggaggacgcagtgcctggagccaacgccacaatcaaggatcggtacctggccagcgcctccgccaatccaggacaggtgttccacatgctgctgaagaatgcctccaaccacaccgccaagctgcggaaggaccctgagagaaagggctctgccatccactacgagatcatgatgcaggagatcatcgacaatatcagcgatttcccagtgaccatgtcctctgatgagcagggcctgtttatgatcggctactatcaccagaggaaggccctgttcacaaagaagaataaggagaactaa

SEQ ID NO: 268 - DNA, 873 bp, Desulfovibrio vulgaris
  misc_feature (1)..(873): Cas7, Desulfovibrio vulgaris RCH1 plasmid pDEVAL01
atgaccgcaatcgcaaaccgctatgagtttgtgctgctgttcgacgtggagaacggcaatccaaacggcgaccccgatgccggcaatatgcctaggatcgacccagagaccggacacggactggtgacagacgtgtgcctgaagagaaagatcaggaaccacgtggccctgacaaaggagggcgccgagaggttcaacatctacatccaggagaaggccatcctgaatgagacccacgagcgcgcctatacagcctgtgacctgaagccagagcccaagaagctgccaaagaaggtggaggacgccaagcgggtgaccgattggatgtgcacaaacttttacgatatcagaaccttcggcgccgtgatgaccacagaagtgaattgtggacaggtgcggggaccagtgcagatggcctttgccagatccgtggagcccgtggtgcctcaggaggtgtctatcacccggatggccgtgaccacaaaggccgaggccgagaagcagcagggcgacaacagaacaatgggcaggaagcacatcgtgccatacggcctgtatgtggcacacggcttcatcagcgcccccctggccgagaagaccggcttttccgacgaggatctgacactgttctgggacgccctggtgaatatgtttgagcacgatcgctccgccgcaaggggactgatgagctcccggaagctgatcgtgtttaagcaccagaatagactgggcaacgcccctgcccacaagctgttcgacctggtgaaggtgtctagggcagagggctctagcggccctgcacgcagcttcgccgattatgcagtgaccgtgggacaggccccagagggagtggaggtgaaggagatgctgtaa

SEQ ID NO: 269 - protein, 227 aa, Desulfovibrio vulgaris
  misc_feature (1)..(227): Cas5, Desulfovibrio vulgaris RCH1 plasmid pDEVAL01
MTHGAVKTYGIRLRVWGDYACFTRPEMKVERVSYDVMPPSAARGILEAIHWKPAIRWIVDRIHVLRPIVFDNVRRNEVSSKIPKPNPATAMRDRKPLYFLVDDGSNRQQRAATLLRNVDYVIEAHFELTDKAGAEDNAGKHLDIFRRRARAGQSFQQPCLGCREFPASFELLEGDVPLSCYAGEKRDLGYMLLDIDFERDMTPLFFKAVMEDGVITPPSRTSPEVRA

SEQ ID NO: 270 - protein, 612 aa, Desulfovibrio vulgaris
  misc_feature (1)..(612): Cas8, Desulfovibrio vulgaris RCH1 plasmid pDEVAL01
MILQALHGYYQRMSADPDAGMPPYGTSMENISFALVLDAKGTLRGIEDLREQEGKKLRPRKMLVPIAEKKGNGIKPNFLWENTSYILGVDAKGKQERTDKCHAAFIAHIKAYCDTADQDLAAVLQFLEHGEKDLSAFPVSEEVIGSNIVFRIEGEPGFVHERPAARQAWANCLNRREQGLCGQCLITGERQKPIAQLHPSIKGGRDGVRGAQAVASIVSFNNTAFESYGKEQSINAPVSQEAAFSYVTALNYLLNPSNRQKVTIADATVVFWAERSSPAEDIFAGMFDPPSTTAKPESSNGTPPEDSEEGSQPDTARDDPHAAARMHDLLVAIRSGKRATDIMPDMDESVRFHVLGLSPNAARLSVRFWEVDTVGHMLDKVGRHYRELEIIPQFNNEQEFPSLSTLLRQTAVLNKTENISPVLAGGLFRAMLTGGPYPQSLLPAVLGRIRAEHARPEDKSRYRLEVVTYYRAALIKAYLIRNRKLEVPVSLDPARTDRPYLLGRLFAVLEKAQEDAVPGANATIKDRYLASASANPGQVFHMLLKNASNHTAKLRKDPERKGSAIHYEIMMQEIIDNISDFPVTMSSDEQGLFMIGYYHQRKALFTKKNKEN

SEQ ID NO: 271 - protein, 290 aa, Desulfovibrio vulgaris
  misc_feature (1)..(290): Cas7, Desulfovibrio vulgaris RCH1 plasmid pDEVAL01
MTAIANRYEFVLLFDVENGNPNGDPDAGNMPRIDPETGHGLVTDVCLKRKIRNHVALTKEGAERFNIYIQEKAILNETHERAYTACDLKPEPKKLPKKVEDAKRVTDWMCTNFYDIRTFGAVMTTEVNCGQVRGPVQMAFARSVEPVVPQEVSITRMAVTTKAEAEKQQGDNRTMGRKHIVPYGLYVAHGFISAPLAEKTGFSDEDLTLFWDALVNMFEHDRSAARGLMSSRKLIVFKHQNRLGNAPAHKLFDLVKVSRAEGSSGPARSFADYAVTVGQAPEGVEVKEML

SEQ ID NO: 272 - DNA, 97 bp, Desulfovibrio vulgaris
  misc_feature (1)..(97): CRISPR, Desulfovibrio vulgaris RCH1 plasmid pDEVAL01
gtcgccccccacgcgggggcgtggattgaaaccagtctcgttaccctgtcgcggagggcgtcgatgtcgccccccacgcgggggcgtggattgaaac

SEQ ID NO: 273 - DNA, 711 bp, Geobacillus thermocatenulatus strain KCTC 3921
  misc_feature (1)..(711): Cas5
atgcagcgtcgagcgaaagtgcaggtgaaggtgtggggggaatatgcttgttttacaagaccagaatttaaagtcgagcgcatcagttatcctgtgatgacgccgagcgcagcgcggggggtattggaagcgatcttttggaagcccgaatttcgctacgaggttcgacaaatcgggattttaagtttaggggggcaacaagcgattttgcgcaacgaactcacaagcaagcaaaataaaaacccgatcgtgattgaaagcgccagggctcaacgaacgagcttgattttaaagaacgtggcgtattggatagttgccgatatcattttaacaaatcgagcggttgatccagcggccaaataccgggatcagtttaaccgacgagttgaacgaggtcagtgtcatcatacgccatatttaggaacaagggagtttgccgcctacttttcatctatagatgaagatgatgttgtgaagccggtcgatatggacattggcacaatgctgttggattttgcttttattgaagacggttcgagaaaagaaatggagtttctccgttatgaagaaacggggacgcgaacggcggttggattcgcgaagccactcttttttgaggcaaaggtagaaaacggttggctgcatgttccaaaagaaacatatcagcagctgtatgcattggagggacaaaatgctttacgagttgattga

SEQ ID NO: 274 - DNA, 1776 bp, Geobacillus thermocatenulatus strain KCTC 3921
  misc_feature (1)..(1776): Cas8
atgcattggagggacaaaatgctttacgagttgattgagttggcggctaagttgcagagggaaaaaaaactaccaccgatctcctataaacctaaatcaatcaattggattattgatttaggtggggatcaaccatatttgaaagggccgtttagaaggggagaataccgtttggtggaagcgccgtttcggttgaggcaagggaaagttacggaagaaaacgtaaagccttatttgttggctgatgatggccgctatgtacttggcatccctgaaagtccagaaaaggcggatgaagcggagttaatgcataaagggtatgttcgattaattgaggaagcttatgagaaaacaaagttgaaagaattaaaaaaagtgctggattttttgtacagtccgatgaagaatgcgttccgtgagcaaattggtgccaaggatatcgtgacgtttcaagatgatgaggagtcattgatttttgaaaagagtgaaattcaaacattttgggctgaatacttggcgagtgatttgctgtccgacgatgaatgtgactgttctgtttgcgggaagcgatcggcttatgtacggtatttgcccaaccctgtccagttatttggacaatcgtgccaactgacgtcgtttaataacccgtcgtttgaatcaatgggcaaaactcaaacgaataatgtacctgtctgcttcgggtgtgctactttggttgtcgatacattgaattatctcattagggaagatcaacatcatactcccctgtatataagcgaccgaaatattttgcaatcccaaatggccatatattgggttgatgaccaaattgaggggaggggatgtatccaacttgatgaaaaattgtttgcatcgccaatcgaacaatggctttttgatgaagatacaaatcaacggactcctccccctgagttgaagcagctcgaggaactgctggctcttccgaaaacagggcgcgagcaggcattgcacttagacaagacgttttttcatatggctgtcctttcggccaataaagcgagattagtcgttcgtgaatggattcatacgtcgatttctcaattgctgatgcatttggagaggtatgcggccgctgtgcgcatcgttcagccgactggggaaaaaggctatttattgccgctggcagctttgattcgcgctgttgatatgtcgccggggctggtgcgccaatgtttgcgcacgatttatcaaggggctttgccgcctactgaattgctgccgttagcgcttcaacgtttccgctctttgaaagtattgagtgatccgaaggaaacgtggagatatcattcatcagccagcttgttaaaactcgttctcacatatggaaaggaggaagcaaatacaatgcaatcgttaaacaaccattgcttgcagccggcttatatttgtggacgattattggccgtattggaagaaattcaacggcgcgctttgggataccgaattggaagcacaatcgtggatcgattttatggcgcggcttctacagctccagcatcgacatttggttcattgctgaggctttcaacaacagctcatctgccaaaagtgtctggtgagcttggccgtttgcttgaggaagtgatgaaacagctggatgaagctggaggtttcccgacgattttcaatttaagagaacaggcagagttcgcacttggtttttatcatcaacgcgctgagttccgcagtcgccatcaaagcaatcaaacaaatggaacgggggaaagccaatga

SEQ ID NO: 275 - DNA, 1116 bp, Geobacillus thermocatenulatus strain KCTC 3921
  misc_feature (1)..(1116): Cas7
atgatggagcgctatatcgatccgacaaaacgtcatgaatttgtgttgctttttgatgtcaaagatgggaatccaaatggggatccagatgcgggcaacatgccgcgtgtcgatccggaaacgatgcacggcattgtgaccgacgttgcgatcaagcggaaaattcgcgattacgccgcgatggtattaggcaaaccgatttttattcaaagccaaacggctttaaacaccatcatttttcaagcatatcaagacgtcggagtgaaactggcgacgattgagctgaatgaagaagaaaaagaaaatggggaattgatgaattggctttcacagcttgaggaacaaggattggtgctcgaagacaatcgggtgatctatactggtgaggacatcaaggagaaggatattcgtgaaaaattaacggaaggattagaagaagctggtcttaaaaaacaactggaaaagtcattgcgaaatatggcgaaacgtctggcacaggcggcaaataatatgaaaattgatgaacaaacacgccaaaatgcgcaaaaggctttatgccaaaagtactatgatgtccgcatgttcggggctgtgatgtcaacaggattgaatgctggtcaagtgcgtgggccgatgcagctgacattttctcgctcaattgacccggtatttccatgggatttgaccatcacacgctccgcgatcaccaaagaatcggatcgccgcagaaaacaaacggaaatgggaagaaaaccgttaattccatacggattgtatcgattgcatggattctacaatccatttttaggagaaaaaacaggggttacggcagaagatttagctgatttttgggatgcgctcgttcatttatttgcatttgaccattctgcggctcgaggagaaatgaatgtcagagcactctatatttttagccatgaaaatgcgaaaggatcagcgccagctcacaagctgtttgacttggtgaaaatcgagcgccgccaacaggaagctccaaggtcattccatgactatgttttgcttggaccggcagatgaggggcagaaagacgtttttcttgaagggttttctggggtcaccgtgacgcgcctcgtataa

SEQ ID NO: 276 - DNA, 711 bp, Geobacillus thermocatenulatus strain KCTC 3921
  misc_feature (1)..(711): Cas5
atgcagagaagggccaaggtgcaggtgaaagtgtggggcgagtacgcctgttttacacgcccagagttcaaggtggagcggatcagctatccagtgatgaccccatccgccgcaaggggcgtgctggaggccatcttttggaagcccgagttcagatacgaggtgaggcagatcggcatcctgagcctgggaggacagcaggcaatcctgcggaacgagctgacatccaagcagaacaagaatcctatcgtgatcgagtctgccagggcacagcggaccagcctgatcctgaagaacgtggcctactggatcgtggccgatatcatcctgacaaatagggcagtggaccccgcagccaagtatagagaccagttcaatcgccgggtggagaggggacagtgccaccacacaccttacctgggcacccgcgagtttgccgcctatttcagctccatcgacgaggacgatgtggtgaagccagtggacatggatatcggcaccatgctgctggatttcgcctttatcgaggacggcagcagaaaggagatggagtttctgagatacgaggagaccggaacacgcaccgcagtgggattcgcaaagccactgttctttgaggccaaggtggagaacggctggctgcacgtgcccaaggagacctaccagcagctgtatgccctggagggccagaatgccctgagggtggattaa

SEQ ID NO: 277 - DNA, 1776 bp, Geobacillus thermocatenulatus strain KCTC 3921
  misc_feature (1)..(1776): Cas8
atgcactggagagataagatgctgtatgagctgatcgagctggccgccaagctgcagagggagaagaagctgcctccaatcagctacaagcccaagtccatcaactggatcatcgatctgggaggcgaccagccttacctgaagggaccatttcgccggggagagtataggctggtggaggcacctttccgcctgaggcagggcaaggtgaccgaggagaatgtgaagccatacctgctggccgacgatggcagatatgtgctgggcatcccagagtcccccgagaaggcagacgaggcagagctgatgcacaagggctacgtgaggctgatcgaggaggcctatgagaagacaaagctgaaggagctgaagaaggtgctggattttctgtattctcctatgaagaacgccttccgggagcagatcggcgccaaggacatcgtgacattccaggacgatgaggagagcctgatctttgagaagtccgagatccagaccttctgggccgagtacctggcctccgatctgctgtctgacgatgagtgcgactgtagcgtgtgcggcaagagaagcgcctacgtgaggtatctgccaaatcccgtgcagctgtttggccagtcttgtcagctgaccagctttaacaatccctctttcgagagcatgggcaagacacagaccaacaatgtgcccgtgtgcttcggctgtgccacactggtggtggataccctgaactacctgatcagagaggaccagcaccacacacctctgtatatctccgataggaatatcctgcagtctcagatggccatctactgggtggacgatcagatcgagggcagaggctgcatccagctggacgagaagctgtttgcctctcctatcgagcagtggctgttcgacgaggatacaaaccagcgcaccccccctccagagctgaagcagctggaggagctgctggccctgccaaagacaggaagggagcaggccctgcacctggacaagaccttctttcacatggccgtgctgtccgccaataaggcaaggctggtggtgcgggagtggattcacacctccatctctcagctgctgatgcacctggagcggtacgcagcagccgtgcggatcgtgcagcctacaggcgagaagggctatctgctgccactggccgccctgatcagggcagtggatatgagcccaggcctggtgagacagtgtctgaggacaatctatcagggcgccctgccacctaccgagctgctgcccctggccctgcagcggttcagaagcctgaaggtgctgtctgaccctaaggagacctggagataccactctagcgcctctctgctgaagctggtgctgacatatggcaaggaggaggccaacaccatgcagagcctgaacaatcactgcctgcagcccgcctacatctgtggcaggctgctggccgtgctggaggagatccagagaagggccctgggctaccggatcggctctaccatcgtggatcggttctacggagcagccagcacagcacctgccagcaccttcggctccctgctgaggctgagcaccacagcacacctgccaaaggtgtccggcgagctgggccggctgctggaggaagtgatgaagcagctggacgaggcaggaggatttccaacaatcttcaatctgagggagcaggcagagtttgcactgggcttctaccaccagagggcagagttccgctctcggcaccagagcaaccagacaaatggcaccggcgagtcccagtaa

SEQ ID NO: 278 - DNA, 1116 bp, Geobacillus thermocatenulatus strain KCTC 3921
  misc_feature (1)..(1116): Cas7
atgatggagagatatatcgatcccaccaagaggcacgagtttgtgctgctgttcgacgtgaaggatggcaaccctaatggcgacccagatgcaggaaacatgccccgggtggaccctgagacaatgcacggcatcgtgaccgatgtggccatcaagagaaagatcagggactatgccgccatggtgctgggcaagcctatctttatccagtctcagacagccctgaacaccatcatcttccaggcctaccaggatgtgggcgtgaagctggccaccatcgagctgaatgaggaggagaaggagaacggcgagctgatgaattggctgagccagctggaggagcagggactggtgctggaggacaatagagtgatctacacaggcgaggatatcaaggagaaggacatcagggagaagctgaccgagggcctggaggaggcaggcctgaagaagcagctggagaagagcctgcgcaacatggcaaagcggctggcccaggccgccaacaatatgaagatcgatgagcagacccgccagaatgcccagaaggccctgtgccagaagtactatgacgtgcggatgttcggcgccgtgatgtccacaggcctgaacgcaggacaggtgaggggaccaatgcagctgaccttttcccgctctatcgatcccgtgttcccatgggacctgaccatcacaagaagcgccatcacaaaggagtccgatcggagaaggaagcagaccgagatgggccgcaagcccctgatcccttacggcctgtatcggctgcacggcttttacaatcccttcctgggcgagaagacaggagtgaccgcagaggacctggcagatttttgggacgccctggtgcacctgttcgcctttgaccacagcgccgcaaggggagagatgaacgtgcgggccctgtatatcttttcccacgagaatgccaagggctctgcccctgcccacaagctgttcgatctggtgaagatcgagcgccggcagcaggaggcaccaagatccttccacgactacgtgctgctgggaccagcagatgagggacagaaggacgtgtttctggagggcttctctggcgtgaccgtgacacggctggtgtaa

SEQ ID NO: 279 - protein, 236 aa, Geobacillus thermocatenulatus strain KCTC 3921
  misc_feature (1)..(236): Cas5
MQRRAKVQVKVWGEYACFTRPEFKVERISYPVMTPSAARGVLEAIFWKPEFRYEVRQIGILSLGGQQAILRNELTSKQNKNPIVIESARAQRTSLILKNVAYWIVADIILTNRAVDPAAKYRDQFNRRVERGQCHHTPYLGTREFAAYFSSIDEDDVVKPVDMDIGTMLLDFAFIEDGSRKEMEFLRYEETGTRTAVGFAKPLFFEAKVENGWLHVPKETYQQLYALEGQNALRVD

SEQ ID NO: 280 - protein, 591 aa, Geobacillus thermocatenulatus strain KCTC 3921
  misc_feature (1)..(591): Cas8
MHWRDKMLYELIELAAKLQREKKLPPISYKPKSINWIIDLGGDQPYLKGPFRRGEYRLVEAPFRLRQGKVTEENVKPYLLADDGRYVLGIPESPEKADEAELMHKGYVRLIEEAYEKTKLKELKKVLDFLYSPMKNAFREQIGAKDIVTFQDDEESLIFEKSEIQTFWAEYLASDLLSDDECDCSVCGKRSAYVRYLPNPVQLFGQSCQLTSFNNPSFESMGKTQTNNVPVCFGCATLVVDTLNYLIREDQHHTPLYISDRNILQSQMAIYWVDDQIEGRGCIQLDEKLFASPIEQWLFDEDTNQRTPPPELKQLEELLALPKTGREQALHLDKTFFHMAVLSANKARLVVREWIHTSISQLLMHLERYAAAVRIVQPTGEKGYLLPLAALIRAVDMSPGLVRQCLRTIYQGALPPTELLPLALQRFRSLKVLSDPKETWRYHSSASLLKLVLTYGKEEANTMQSLNNHCLQPAYICGRLLAVLEEIQRRALGYRIGSTIVDRFYGAASTAPASTFGSLLRLSTTAHLPKVSGELGRLLEEVMKQLDEAGGFPTIFNLREQAEFALGFYHQRAEFRSRHQSNQTNGTGESQ

SEQ ID NO: 281 - protein, 371 aa, Geobacillus thermocatenulatus strain KCTC 3921
  misc_feature (1)..(371): Cas7
MMERYIDPTKRHEFVLLFDVKDGNPNGDPDAGNMPRVDPETMHGIVTDVAIKRKIRDYAAMVLGKPIFIQSQTALNTIIFQAYQDVGVKLATIELNEEEKENGELMNWLSQLEEQGLVLEDNRVIYTGEDIKEKDIREKLTEGLEEAGLKKQLEKSLRNMAKRLAQAANNMKIDEQTRQNAQKALCQKYYDVRMFGAVMSTGLNAGQVRGPMQLTFSRSIDPVFPWDLTITRSAITKESDRRRKQTEMGRKPLIPYGLYRLHGFYNPFLGEKTGVTAEDLADFWDALVHLFAFDHSAARGEMNVRALYIFSHENAKGSAPAHKLFDLVKIERRQQEAPRSFHDYVLLGPADEGQKDVFLEGFSGVTVTRLV

SEQ ID NO: 282 - DNA, 111 bp, Geobacillus thermocatenulatus strain KCTC 3921
  misc_feature (1)..(111): CRISPR
gttgcacccggctattaagccgggtgaggattgaaactatatcacacagcttcttagtatcatcgacaacacgtgttgcacccggctattaagccgggtgaggattgaaac

SEQ ID NO: 283 - DNA, 1263 bp, Vibrio cholerae strain L15
  misc_feature (1)..(1263): Cas8
gtgatagatccagtaatagccgccttttttgcggaacgtaaagaagcatggctaaagaagaatatcagtgcagcgatgtctgatgcagaagtcttggaaaaacaacaggagtgtgagcaaaactttctattagacaattggttgcctgatgcggccaaaagggcggggcaaatttcagtggcttcacatccttgtacctttagtcatccgagtgcgcggaaaaacaaaaatggctacgtatcgtccattattgccaagaacaaaccaagaatagatggttttcttcgctctggtaatgtgagtgttgagccagatgcacttggtaacgcagcagcattagatgtatacaagtttctcagcttagagatgagcgaccaacgttctttattggtgcatattgaacaagaaagcgagttagcaaggcaattgcttgatataccaagttgtgaatatcaggcgctacgcgatggctttttaaaaatggtcgatagcgatcaggcgtctgtttccagctcgaagattaagcaagtttatttcccgatagccgatggggaatatcatttattgtcgttattaacccattccggccatctttttgaattgcgtaaacgtctagatgcacttcgatttggtgatgcggtaaaagaggcaagagagtgcaaaaaaacgaatcactttcaccccgcgggttaccaagagatctttggtctcaccacgattgggtttggcggcacaaaaccgcaaaatatcagcgtgctcaataaccaaaacgcaggtaaagcacatttactagcctctattccacctgagttaacacctcgcgatattcgtctgccgaaaacggattttttcaaagagagttttaacgcttggcaagccaaagaagtacttgaatcgttgcatcgactctttcaaaccgactgcaacaacatcaatctccgtgatggccgtgactaccgcattcagcaatacgtagatttggtgattgaaaaaatgtggcaagtacgcctgtttcttgaagcgtattccggtgaactatcgagtgcgttgccgttggagcaaaaaatctggctctatccagagtttgctgagcagcgtcagcaagaggatgagtggctcgataaaatcattcgccacattgcgcgaggcttaatcaaccattacagccgcagcaaagtgatcactaatcccgtcacattggcagaccaagagctgctggcgatagaagaggtggttgccagcaataaggagaacttgcgatga

SEQ ID NO: 284 - DNA, 888 bp, Vibrio cholerae strain L15
  misc_feature (1)..(888): Cas5
atgaacgtattgatcttaccgcatcttaaaattcacaacgccaatgcactttcaagcccctttactgttggctttcctgccatgacggcatggctaggctttgtacatgccttagagcgcaagctcagccaagcagggttatccgatctcatgctgcatagtactgctgtagtgagccaccgttgtgatgtacagactcataaaggcgaaggtgactttgttcattcaattatcggtactgccaatccactcgataaggatggttcacgctcggcatttatcgaggaagcacgctgtcatttagatgtgtcccttgtcattgagtggagtggcaatgaagagcaagttcaacagccagagtttaccgagcagttgcaagcagtgatcgcgacgatgaaagtcgcagggggcgacgttcttgccgttgggaagccctcagttaaatctgtgatcactgaggatgatactggcagagttctgcgccagttaatgcctggttatgtgctgatcgaacgccgcgatttaatgattgacgccatgcagcaaggtgatgacgcaatagatgcgctgctgggttacctcacagtgcaccaccattgtgagcagcttgaagaccaaagtgttgtttggcatagccagcgcaaaacgagtggctggattgtgccgattgccactggttttcaaggtatttcaccgttaggtgaggcaaaaaatcagcgcgatccatcagtgccgcatcgctttgctgaaagtgtggtcacgctgggtgaatttgtcatggtgcacaaaatcaaacatctcgatgacatcctttggcaataccacccggatttagaaaacgatctttacctttgtcagaaagttaacgctatcaacgaacatcaataa

SEQ ID NO: 285 - DNA, 1032 bp, Vibrio cholerae strain L15
  misc_feature (1)..(1032): Cas7
atggctaaaaataacgacatcgcatcagtactcgcatttgaaaaaaaactagtcccatcggatggctacctctttggatgtcagtgggaaaccaaagagcaagcaaccccattaaccctgcaagagaaatcagtacgtggcactatctccaaccgtttaaaagccgcagtacaaaatgatcccgctaagcttaatgcggaagttgaaaaagcaaacttgcagcgagtggatgcctgtgcgttggggcaggatcacgatactttgaagctacatttcacactcaaagtattagggggacttgcccaaccttcggcgtgtaacaatgcgctgttcaaacagagctacagtactgcggtttcgcagtacattaccaaatatggctgtttcgaattggcgaaacgttatgccaccaaccttgccaatgcccgttttctatggcgcaaccgcgttggcgcagaagagattgaagtgcaagtcaaagcattaaacaaaggggctgagcagacttggacttttaatgccaaacaattcagtactcgccactttgatcataacgactcacagctcaatagtctggccgacagaattgctcaggcactggccagcgaaacagatcatttgatgttgcaaattgactgctatgccaaagtcggtaaagcccaagaagtttaccccagtgaagagttagtgctcgataagggcaacagcaaaaccaagaaaagtaaaatcctgtatgcagttaatgagcatgctgcgatgcattcacaaaaaattggtaacgcactgcgttccattgatacttggtacccagattacgcatctgaggagcaaagtgcaggagccattgcgattgaaccctatggcgctgttaccaatttaggaaaggcgttccgcacaccgaaagataagcaagatttttacactttctttgataaatgggcgcgtggtgaaagtttgccccgtgaagaagatgagcattacgtcatggcggtattggtgcgtggtggtgtatttggcgaaagtgacaaatag

SEQ ID NO: 286 - DNA, 639 bp, Vibrio cholerae strain L15
  misc_feature (1)..(639): Cas6
atgaactactaccaagagatcacgttattgccagatgccgacattgccttgggctttctttggcaaaacgtctttcaacaagtgcacattgctttagtggagcacaaagtggcgagcaaccaatctctggttgcggtcggttttcctgattatcgccaagcaaagtttccgctcggcgcaaagctgcgtctctttgcaaaagagcaagtaacactggaaaagttggatatccaccgctggctaactcggctagaagactatgtgcacatcaaaggggtcaaacccgtaccaagcgatgtaacttatgtaagctttgtacgcaagcaggtgaaatcgcccgaacgaatagagcgggatatgcagcaaaaagccgaactatgggcagcaaaatctggtaaaccgctggtggaatgtttagtggatttacaacaaagcaagccgacagcgttgtgctccttgccctttatttacttgcatagccagcaaaccaagcaacgttcaccagaaaaaaacagcaagttcccgctgtttattgagatgcagcagcaaagcacatctcaagatgggggcttcgattgctatggtttgagtagcaaagcgaatgggcagtcaatgttggctactgtaccgcacttttaa

SEQ ID NO: 287 - DNA, 1263 bp, Vibrio cholerae strain L15
  misc_feature (1)..(1263): Cas8
atgatcgacccagtgatcgccgccttctttgccgagaggaaggaggcctggctgaagaagaatatcagcgccgcaatgtccgatgcagaggtgctggagaagcagcaggagtgcgagcagaacttcctgctggacaattggctgcccgatgcagcaaagagggcaggacagatctctgtggccagccacccatgtacattttcccacccctctgcccgcaagaacaagaatggctacgtgtcctctatcatcgccaagaacaagccacgcatcgacggcttcctgcggtctggcaacgtgagcgtggagccagacgccctgggaaatgcagccgccctggacgtgtacaagtttctgtccctggagatgtctgatcagcgcagcctgctggtgcacatcgagcaggagagcgagctggccaggcagctgctggacatcccttcctgcgagtatcaggccctgagagatggcttcctgaagatggtggactccgatcaggcctctgtgagctcctctaagatcaagcaggtgtactttccaatcgccgacggcgagtatcacctgctgtccctgctgacccactctggccacctgttcgagctgaggaagcgcctggacgccctgaggtttggcgatgccgtgaaggaggcccgggagtgtaagaagaccaaccacttccacccagccggctaccaggagatcttcggcctgaccacaatcggctttggcggcacaaagccccagaacatcagcgtgctgaacaatcagaatgcaggcaaggcacacctgctggcctccatcccccctgagctgacccctcgggacatcagactgccaaagacagatttctttaaggagtccttcaacgcctggcaggccaaggaggtgctggagtctctgcacagactgtttcagaccgactgcaacaatatcaatctgagggacggccgcgattacagaatccagcagtatgtggacctggtcatcgagaagatgtggcaggtgaggctgttcctggaggcctacagcggcgagctgagctccgccctgcctctggagcagaagatctggctgtatccagagtttgcagagcagaggcagcaggaggacgagtggctggataagatcatccgccacatcgcccggggcctgatcaaccactacagccggtccaaagtgatcaccaatcctgtgacactggccgaccaggagctgctggccatcgaggaggtggtggcctccaacaaggagaatctgagataa

SEQ ID NO: 288 - DNA, 888 bp, Vibrio cholerae strain L15
  misc_feature (1)..(888): Cas5
atgaatgtgctgatcctgcctcacctgaagatccacaacgccaatgccctgtctagcccctttaccgtgggcttccctgccatgacagcatggctgggattcgtgcacgccctggagagaaagctgtcccaggccggcctgtctgatctgatgctgcacagcaccgcagtggtgtcccacaggtgcgacgtgcagacacacaagggcgagggcgatttcgtgcacagcatcatcggcaccgccaaccccctggacaaggatggcagccgctccgcctttatcgaggaggcccggtgtcacctggacgtgagcctggtcatcgagtggtccggcaatgaggagcaggtgcagcagcctgagtttaccgagcagctgcaggccgtgatcgccacaatgaaggtggcaggaggcgatgtgctggccgtgggcaagccttccgtgaagtctgtgatcaccgaggacgatacaggcagggtgctgaggcagctgatgccaggatacgtgctgatcgagcggagagacctgatgatcgatgccatgcagcagggcgacgatgcaatcgacgccctgctgggctatctgaccgtgcaccaccactgcgagcagctggaggatcagtctgtggtgtggcacagccagcggaagacctccggctggatcgtgcccatcgccacaggcttccagggcatctcccctctgggcgaggccaagaaccagagagaccctagcgtgccacacaggttcgcagagtccgtggtgaccctgggagagtttgtgatggtgcacaagatcaagcacctggacgatatcctgtggcagtaccacccagacctggagaacgatctgtatctgtgccagaaggtgaacgccatcaatgagcaccagtaa

SEQ ID NO: 289 - DNA, 1032 bp, Vibrio cholerae strain L15
  misc_feature (1)..(1032): Cas7
atggccaagaacaatgacatcgcctctgtgctggccttcgagaagaagctggtgcctagcgatggctacctgtttggctgccagtgggagaccaaggagcaggccaccccactgacactgcaggagaagagcgtgagaggcacaatctccaacaggctgaaggccgccgtgcagaacgaccctgccaagctgaatgccgaggtggagaaggccaatctgcagcgggtggatgcctgtgcactgggacaggaccacgataccctgaagctgcacttcacactgaaggtgctgggaggcctggcccagccatctgcctgcaacaatgccctgtttaagcagtcttacagcaccgccgtgagccagtacatcacaaagtatggctgtttcgagctggccaagagatatgccaccaacctggccaatgccaggtttctgtggcggaacagagtgggcgccgaggagatcgaggtgcaggtgaaggccctgaacaagggcgccgagcagacctggaccttcaacgccaagcagttctctaccaggcactttgaccacaacgatagccagctgaattccctggccgacaggatcgcacaggccctggccagcgagacagaccacctgatgctgcagatcgattgctacgccaaagtgggcaaggcccaggaggtgtatccctccgaggagctggtgctggataagggcaacagcaagaccaagaagtccaagatcctgtacgccgtgaacgagcacgccgccatgcactctcagaagatcggcaatgccctgcgcagcatcgacacatggtaccctgattatgcctctgaggagcagagcgccggagcaatcgcaatcgagccctacggcgccgtgaccaatctgggcaaggccttcagaacccctaaggacaagcaggacttctacaccttctttgacaagtgggcaaggggagagagcctgcctagggaggaggatgagcactacgtgatggccgtgctggtgcggggaggcgtgttcggagagtccgacaagtaa

SEQ ID NO: 290 - DNA, 639 bp, Vibrio cholerae strain L15
  misc_feature (1)..(639): Cas6
atgaattactatcaggagatcacactgctgcccgacgcagatatcgccctgggcttcctgtggcagaacgtgtttcagcaggtgcacatcgccctggtggagcacaaggtggcctctaatcagagcctggtggccgtgggcttccctgactacagacaggccaagtttccactgggcgccaagctgaggctgttcgccaaggagcaggtgaccctggagaagctggacatccacagatggctgacaaggctggaggattacgtgcacatcaagggcgtgaagccagtgccctctgacgtgacctatgtgagctttgtgagaaagcaggtgaagtcccccgagcggatcgagagagatatgcagcagaaggccgagctgtgggccgccaagtctggcaagcctctggtggagtgcctggtggacctgcagcagtccaagcccaccgccctgtgctctctgcctttcatctacctgcacagccagcagacaaagcagaggtctccagagaagaacagcaagtttcccctgttcatcgagatgcagcagcagtccacatctcaggacggcggcttcgattgctatggcctgagctccaaggccaatggccagagcatgctggccaccgtgccacacttttaa

SEQ ID NO: 291 - protein, 420 aa, Vibrio cholerae strain L15
  misc_feature (1)..(420): Cas8
MIDPVIAAFFAERKEAWLKKNISAAMSDAEVLEKQQECEQNFLLDNWLPDAAKRAGQISVASHPCTFSHPSARKNKNGYVSSIIAKNKPRIDGFLRSGNVSVEPDALGNAAALDVYKFLSLEMSDQRSLLVHIEQESELARQLLDIPSCEYQALRDGFLKMVDSDQASVSSSKIKQVYFPIADGEYHLLSLLTHSGHLFELRKRLDALRFGDAVKEARECKKTNHFHPAGYQEIFGLTTIGFGGTKPQNISVLNNQNAGKAHLLASIPPELTPRDIRLPKTDFFKESFNAWQAKEVLESLHRLFQTDCNNINLRDGRDYRIQQYVDLVIEKMWQVRLFLEAYSGELSSALPLEQKIWLYPEFAEQRQQEDEWLDKIIRHIARGLINHYSRSKVITNPVTLADQELLAIEEVVASNKENLR

SEQ ID NO: 292 - protein, 295 aa, Vibrio cholerae strain L15
  misc_feature (1)..(295): Cas5
MNVLILPHLKIHNANALSSPFTVGFPAMTAWLGFVHALERKLSQAGLSDLMLHSTAVVSHRCDVQTHKGEGDFVHSIIGTANPLDKDGSRSAFIEEARCHLDVSLVIEWSGNEEQVQQPEFTEQLQAVIATMKVAGGDVLAVGKPSVKSVITEDDTGRVLRQLMPGYVLIERRDLMIDAMQQGDDAIDALLGYLTVHHHCEQLEDQSVVWHSQRKTSGWIVPIATGFQGISPLGEAKNQRDPSVPHRFAESVVTLGEFVMVHKIKHLDDILWQYHPDLENDLYLCQKVNAINEHQ

SEQ ID NO: 293 - protein, 343 aa, Vibrio cholerae strain L15
  misc_feature (1)..(343): Cas7
MAKNNDIASVLAFEKKLVPSDGYLFGCQWETKEQATPLTLQEKSVRGTISNRLKAAVQNDPAKLNAEVEKANLQRVDACALGQDHDTLKLHFTLKVLGGLAQPSACNNALFKQSYSTAVSQYITKYGCFELAKRYATNLANARFLWRNRVGAEEIEVQVKALNKGAEQTWTFNAKQFSTRHFDHNDSQLNSLADRIAQALASETDHLMLQIDCYAKVGKAQEVYPSEELVLDKGNSKTKKSKILYAVNEHAAMHSQKIGNALRSIDTWYPDYASEEQSAGAIAIEPYGAVTNLGKAFRTPKDKQDFYTFFDKWARGESLPREEDEHYVMAVLVRGGVFGESDK

SEQ ID NO: 294 - protein, 212 aa, Vibrio cholerae strain L15
  misc_feature (1)..(212): Cas6
MNYYQEITLLPDADIALGFLWQNVFQQVHIALVEHKVASNQSLVAVGFPDYRQAKFPLGAKLRLFAKEQVTLEKLDIHRWLTRLEDYVHIKGVKPVPSDVTYVSFVRKQVKSPERIERDMQQKAELWAAKSGKPLVECLVDLQQSKPTALCSLPFIYLHSQQTKQRSPEKNSKFPLFIEMQQQSTSQDGGFDCYGLSSKANGQSMLATVPHF

SEQ ID NO: 295 - DNA, 88 bp, Vibrio cholerae strain L15
  misc_feature (1)..(88): CRISPR
gttcactgccgtacaggcagcttagaaaaatatgcaggggtttgaaacgctcgatgttatgttcactgccgtacaggcagcttagaaa

SEQ ID NO: 296 - DNA, 1314 bp, Klebsiella oxytoca strain ICU1-2b
  misc_feature (1)..(1314): Cas8
atgacaaccgaagcactgactcacttcatcatcgactacatcgcttcacgaaagcagcccaaattagacgcctttgaaaaagaggcggcgaaacggttggctcaaggcgaggatgctggcgctatcgcgcaggagcgtcaggagcttgaagtgaagtatcagccgcgcaactggctgacggatgcggcaagacgtgctgggcaaatcagccttgtcactcatgcggcgaagtttacccacggtgactcaaaaagcagcagcatttaccgcgaaacggtgggcgatgagggctatttaagtacagctgtgctggctaacgtggcggcggatgcggtgggcaacgcggctgctctggacgtggcaaaactgctgcaaaccgaagtgggcggcgattcgctgctggcctgcctgaaacgcggcgatcgtagtccgctgatgggctttgctgaaaacgacgcccagctggcactgtggatggaaggattctctcaggcgttaacgcctgctcaacccacctcgcataagcttgccaaacagatttactttccagtcgatggcggctatcacctgctatctccgctatttgcctcctcgctggcgcaggcgatgcatgaaaaaatggtggcagcacgatttggcgaacaagcaaaagccgcgcgtgaagctcgccgggcgggtaaatggcatgcgcagcccgatgtgcgctatccgaatgttgccgaaatgcattttggcggcactaaaccgcagaatatttcggcgttaaacagctcgcgcggtgggcgggtctggctgctgccgtcgcagccgccaaaatggacaatgctcgataaggcgccgcaaaatctgactagtctctttgcactacgcggcgattttaaccgagcggcaaccgacactgtttcccggatggtttctctacttaaagagaagactgataacaataatcgccatatccgcaacgctcgggcgggttatgttgatgaactgattgatttgttatttcttcatgcagcgacgtaccagcaggaagcgtggcagggatggacgcttaacagcccggatttacctctccaccagcagctttggctcgatccctggcgtagcaaaacagacgagacattccgctctgagcgtgaaaaaggcgactggcaacgaagcgtcgcggatgacttcgcgcgctggctgaactatcgcctgaataaagcgcgtctcgatgtggggatcgccgagcgccgtgagtggcaaactcagcgtctgtttagtcaacggatgcgggaaatggaagctattgtgcaggaggcgctgaaatga

SEQ ID NO: 297 - DNA, 936 bp, Klebsiella oxytoca strain ICU1-2b
  misc_feature (1)..(936): Cas5
atgagctatctgcttttattgccccatattcgcatcgaaaacgcaaatgcggtggcaggattaacctggggattccccgctattacccactttttagggtatgttcatgcgctttcccgcagggtgagcgaatttggcgtctctttcaccggctgcgcggtgattaatcatgaacaccatattcaggcctattcctccgggcgcgactatcaatttgcgctgactcgtaatccgctgaccaaagaaggtaaaaccgctgcctttaacgaagaggggcgaatgcatcttaccgtctctttgcttgttgaatgccagggcgaaatcatcaatggcgaatatggcaaagcggcgctctgttcgtctctgcttacgctctgccagagccacaaactggcgggcggaagtatcgtgatgatgcgtgagccacagatatttaatgcgcctgatgatgaaagaacgctgcgtaagatcctctggcgtctgatgccgggttttgcactctgcgatcgcagcgagtggttgatggagcactatcgccagctgcagcagcggaggccggaaagcagcttactggatgcgtggcttgacttcgcggcgatcaaatatcagcccgttcagcaggaaccggaggatagcatgagctgggagtatcagccgaaaccgaagccggggtatctggtgccgctgatgtgcggatatcaacgtatttcccgactataccagccgggagaagtggccaacgttcgcgataccacaacgccgttcgcctttaccgaggccgtttatggcgttggagaatggcgtgggttacatcgtatagctgaccttgagccgcttatctggcgctaccgcacgagcgatacaggctactactgttctgcaatgcctgttgctgatgatgattttatatttaacgaagatgacgatttagaataa

SEQ ID NO: 298 - DNA, 1002 bp, Klebsiella oxytoca strain ICU1-2b
  misc_feature (1)..(1002): Cas7
atggcaaaggctcctgtatctgtaaaaacggcttccgtactggcatttgaacgcaagctcgccacctccgatgcgatgatgtatgcggggaactggctgggcgatagctggcaaccgatcgaaattaaggaaaaagcggtacgtggaactatctcgaaccggcttaaaaatgccatcgccagcgatgcaacaaagctggatgccgagatccaaaaagcgaatctgcaacgagtggatacggcggcgttgcccgctgatgccgacaccttaaaagtcgtattcaccctgcgggtgctggggaacttagcgacgccatcggtctgtaatgatatggcctatcagaatgcgattcagcagacgatcgaaggttatatcagcgagcacggttttgccgaactggctcgtcgctatgcggctaacctcgcaaatgggcgttttctatggcgcaaccgcattggcgctgagcagattcaggttagcgtgagcgcgcaggggcaggcgtgggtattcaatggccacgattattcattacgtgaattctctcaggacgatgaggaaatagcctcccttgcggcgctgatcgaacaggggctaagtggccaggcgtgggtgatgctaacggttgaggcgcaggtacgtttgggcgccgggcaggaggtctttccgtcacaggagctggtactggatagcaacagtagtaaaagtcgcgtgctgtatcaggtcgcgggcatcgccgggatccactcgcagaagatcggcaatgcgctgcgcactatcgatacctggcatccaaaagttgatgagctgggggcgattgcggtagagccgtacggctcggtaaccagccgcggtatggcctgtcgtcagccgaaggacaagatggatttttataccctgctggatagctgggtgacgaaaggcattaagccagacgtcgaacagcagcattatgtcatggcggttcttatccggggtggtgtattcggtgagaaaagcgaataa

SEQ ID NO: 299 - DNA, 555 bp, Klebsiella oxytoca strain ICU1-2b
  misc_feature (1)..(555): Cas6
atggactatttcctggatattcgcgttctgcctgacccggaatttagcgaagagatgcttatggccgcactgtttgccaaactgcaccgcgctttaggagccagaggcaagggggatattggcgtcagttttcctgagttttccgtcaagccggggccattattacgtttacatggtgatgaatctgcactgtgcgcgctggaagaaacgctctggcgtaaagggctgaatgattattgtcagagtgggcagataatgccggtagaggaaataaaaggatggcgttgcgtcagtcgggtacaggtaaaaagcagccccgagcggctgatgcgccgctcggtgagaaaaggctggctgacacaggatgaagcaaatgagcgattgcttagcatgcggggagagtcgacagcgctcccctggttgaatatgaaaagcctctcaaatgggcagaagtttccgctatttatttgtcacggtgagctgctggcgcagcgcgtcgcgggaacattcaatagctatgggctgagccatatcgcgactatcccctggttttag

SEQ ID NO: 300 - DNA, 1314 bp, Klebsiella oxytoca strain ICU1-2b
  misc_feature (1)..(1314): Cas8
atgacaaccgaggccctgacacactttatcatcgactacatcgcctcccggaagcagccaaagctggatgccttcgagaaggaggccgccaagagactggcccagggagaggacgcaggagcaatcgcccaggagaggcaggagctggaggtgaagtatcagccaaggaactggctgaccgatgcagcaaggagggcaggacagatcagcctggtgacccacgccgccaagttcacacacggcgactccaagtcctctagcatctacagagagaccgtgggcgatgagggctatctgtccacagccgtgctggccaatgtggcagcagacgcagtgggaaacgcagccgccctggatgtggcaaagctgctgcagacagaagtgggaggcgacagcctgctggcctgtctgaagaggggcgatcgctccccactgatgggctttgccgagaatgacgcacagctggccctgtggatggagggcttctcccaggccctgaccccagcccagcctacatctcacaagctggccaagcagatctactttcctgtggatggcggctatcacctgctgagcccactgttcgcctcctctctggcccaggccatgcacgagaagatggtggcagcaaggtttggagagcaggcaaaggcagcaagagaggcaaggagagccggcaagtggcacgcacagccagacgtgcgctaccctaacgtggccgagatgcacttcggcggcaccaagccccagaatatctccgccctgaacagctcccggggaggcagagtgtggctgctgccctctcagccccctaagtggaccatgctggacaaggcccctcagaatctgacaagcctgtttgccctgagaggcgacttcaacagggccgccacagataccgtgagccggatggtgtccctgctgaaggagaagacagataacaataacaggcacatccgcaatgcaagggcaggatacgtggacgagctgatcgatctgctgtttctgcacgccgccacctatcagcaggaggcctggcagggctggacactgaactccccagacctgccactgcaccagcagctgtggctggacccctggaggtccaagacagatgagacctttagatctgagagggagaagggcgactggcagcgcagcgtggcagacgatttcgcaaggtggctgaattaccggctgaacaaggccagactggatgtgggaatcgcagagaggagggagtggcagacccagcggctgttcagccagcggatgagagagatggaggccatcgtgcaggaggccctgaagtaa

SEQ ID NO: 301 - DNA, 936 bp, Klebsiella oxytoca strain ICU1-2b
  misc_feature (1)..(936): Cas5
atgtcttacctgctgctgctgccccacatccgcatcgagaatgcaaacgcagtggcaggactgacctggggatttcctgccatcacacacttcctgggctatgtgcacgccctgtcccggagagtgtctgagtttggcgtgtccttcaccggctgcgccgtgatcaatcacgagcaccacatccaggcctactcctctggccgggactatcagtttgccctgacaagaaatcctctgaccaaggagggcaagacagccgccttcaacgaggagggcagaatgcacctgaccgtgagcctgctggtggagtgtcagggcgagatcatcaatggagagtacggcaaggccgccctgtgcagctccctgctgaccctgtgccagagccacaagctggccggaggctccatcgtgatgatgagggagccacagatctttaacgcccccgacgatgagaggaccctgcgcaagatcctgtggaggctgatgccaggattcgcactgtgcgataggtccgagtggctgatggagcactacaggcagctgcagcagaggcgccctgagtctagcctgctggacgcctggctggatttcgccgccatcaagtatcagcctgtgcagcaggagccagaggacagcatgtcctgggagtaccagcccaagcctaagccaggctatctggtgcccctgatgtgcggctaccagcggatcagcagactgtatcagccaggcgaggtggccaacgtgagggataccacaacccccttcgcctttaccgaggccgtgtacggagtgggagagtggagaggactgcacaggatcgccgacctggagccactgatctggaggtatcgcacatctgataccggctactattgcagcgccatgcccgtggccgacgatgacttcatctttaatgaggatgacgatctggagtaa

SEQ ID NO: 302 - DNA, 1002 bp, Klebsiella oxytoca strain ICU1-2b
  misc_feature (1)..(1002): Cas7
atggcaaaggcacccgtgtctgtgaagaccgccagcgtgctggcctttgagaggaagctggccacatccgacgccatgatgtacgccggcaactggctgggcgattcttggcagcctatcgagatcaaggagaaggccgtgaggggcaccatcagcaatcgcctgaagaacgccatcgcctccgacgccacaaagctggatgccgagatccagaaggcaaatctgcagcgggtggacaccgccgccctgccagccgacgccgataccctgaaggtggtgttcacactgagagtgctgggaaacctggcaaccccaagcgtgtgcaatgatatggcctaccagaacgccatccagcagacaatcgagggctatatcagcgagcacggatttgcagagctggcccggagatacgccgccaatctggccaacggcagattcctgtggcggaatagaatcggcgccgagcagatccaggtgtctgtgagcgcccagggacaggcctgggtgtttaacggccacgactattccctgagggagttctctcaggacgatgaggagatcgcctctctggccgccctgatcgagcagggactgagcggccaggcctgggtcatgctgaccgtggaggcacaggtgcggctgggagcaggccaggaggtgtttccatctcaggagctggtgctggatagcaatagctccaagtcccgcgtgctgtaccaggtggcaggaatcgcaggcatccacagccagaagatcggcaacgccctgcggacaatcgacacctggcaccccaaggtggatgagctgggagcaatcgcagtggagccttacggcagcgtgacctcccgcggaatggcatgcaggcagcccaaggacaagatggacttctacaccctgctggactcctgggtgacaaagggcatcaagcctgatgtggagcagcagcactacgtgatggccgtgctgatcaggggaggcgtgttcggcgagaagtctgagtaa

SEQ ID NO: 303 - DNA, 555 bp, Klebsiella oxytoca strain ICU1-2b
  misc_feature (1)..(555): Cas6
atggactacttcctggatatcagagtgctgccagaccccgagttttccgaggagatgctgatggccgccctgttcgccaagctgcacagagccctgggagcaaggggcaagggcgatatcggcgtgtcttttccagagttcagcgtgaagcctggaccactgctgaggctgcacggcgacgagtccgccctgtgcgccctggaggagaccctgtggagaaagggcctgaatgattattgtcagtctggccagatcatgcctgtggaggagatcaagggatggagatgcgtgagccgggtgcaggtgaagtctagcccagagaggctgatgaggcgcagcgtgcgcaagggatggctgacccaggacgaggcaaacgagcgcctgctgtccatgaggggagagtctacagccctgccttggctgaatatgaagtccctgtctaacggccagaagtttccactgttcatctgccacggagagctgctggcccagcgcgtggcaggcacctttaattcttacggcctgagccacatcgccacaatcccttggttctaa

SEQ ID NO: 304 - protein, 437 aa, Klebsiella oxytoca strain ICU1-2b
  misc_feature (1)..(437): Cas8
MTTEALTHFIIDYIASRKQPKLDAFEKEAAKRLAQGEDAGAIAQERQELEVKYQPRNWLTDAARRAGQISLVTHAAKFTHGDSKSSSIYRETVGDEGYLSTAVLANVAADAVGNAAALDVAKLLQTEVGGDSLLACLKRGDRSPLMGFAENDAQLALWMEGFSQALTPAQPTSHKLAKQIYFPVDGGYHLLSPLFASSLAQAMHEKMVAARFGEQAKAAREARRAGKWHAQPDVRYPNVAEMHFGGTKPQNISALNSSRGGRVWLLPSQPPKWTMLDKAPQNLTSLFALRGDFNRAATDTVSRMVSLLKEKTDNNNRHIRNARAGYVDELIDLLFLHAATYQQEAWQGWTLNSPDLPLHQQLWLDPWRSKTDETFRSEREKGDWQRSVADDFARWLNYRLNKARLDVGIAERREWQTQRLFSQRMREMEAIVQEALK

SEQ ID NO: 305 - protein, 311 aa, Klebsiella oxytoca strain ICU1-2b
  misc_feature (1)..(311): Cas5
MSYLLLLPHIRIENANAVAGLTWGFPAITHFLGYVHALSRRVSEFGVSFTGCAVINHEHHIQAYSSGRDYQFALTRNPLTKEGKTAAFNEEGRMHLTVSLLVECQGEIINGEYGKAALCSSLLTLCQSHKLAGGSIVMMREPQIFNAPDDERTLRKILWRLMPGFALCDRSEWLMEHYRQLQQRRPESSLLDAWLDFAAIKYQPVQQEPEDSMSWEYQPKPKPGYLVPLMCGYQRISRLYQPGEVANVRDTTTPFAFTEAVYGVGEWRGLHRIADLEPLIWRYRTSDTGYYCSAMPVADDDFIFNEDDDLE

SEQ ID NO: 306 - protein, 333 aa, Klebsiella oxytoca strain ICU1-2b
  misc_feature (1)..(333): Cas7
MAKAPVSVKTASVLAFERKLATSDAMMYAGNWLGDSWQPIEIKEKAVRGTISNRLKNAIASDATKLDAEIQKANLQRVDTAALPADADTLKVVFTLRVLGNLATPSVCNDMAYQNAIQQTIEGYISEHGFAELARRYAANLANGRFLWRNRIGAEQIQVSVSAQGQAWVFNGHDYSLREFSQDDEEIASLAALIEQGLSGQAWVMLTVEAQVRLGAGQEVFPSQELVLDSNSSKSRVLYQVAGIAGIHSQKIGNALRTIDTWHPKVDELGAIAVEPYGSVTSRGMACRQPKDKMDFYTLLDSWVTKGIKPDVEQQHYVMAVLIRGGVFGEKSE

SEQ ID NO: 307 - protein, 184 aa, Klebsiella oxytoca strain ICU1-2b
  misc_feature (1)..(184): Cas6
MDYFLDIRVLPDPEFSEEMLMAALFAKLHRALGARGKGDIGVSFPEFSVKPGPLLRLHGDESALCALEETLWRKGLNDYCQSGQIMPVEEIKGWRCVSRVQVKSSPERLMRRSVRKGWLTQDEANERLLSMRGESTALPWLNMKSLSNGQKFPLFICHGELLAQRVAGTFNSYGLSHIATIPWF

SEQ ID NO: 308 - DNA, 88 bp, Klebsiella oxytoca strain ICU1-2b
  misc_feature (1)..(88): CRISPR
gttcactgccgtacaggcagcttagaaaaaaaactgagcggccgcagaatgaagttgtaagttcactgccgtacaggcagcttagaaa

SEQ ID NO: 309 - DNA, 1305 bp, Pseudomonas aeruginosa UCBPP-PA14
  misc_feature (1)..(1305): Cas8
atgacctctcccctcccaacgcctacgtggcaggagcttcgccagttcatcgaatccttcatccaggagcgcctccagggcaagctggacaaactccaacccgacgaagacgacaagcgccagacattgctggccacccaccggcgggaggcctggctggccgatgccgcccggcgggttggccagttgcagttggtgacccacacgctcaagccgatccatcccgacgcccgcggcagcaacctgcacagcctgccgcaagcacccggccaaccgggcctcgccggttcccatgagctaggtgacaggctggtcagcgatgtggtgggcaatgccgcggcgctggacgtattcaagtttctcagtctccagtatcagggtaaaaatcttctgaactggctgacagaagacagtgccgaggcattacaggcgctgtccgataacgccgaacaggctcgcgaatggcggcaagcgttcatcggcatcacgaccgtcaaaggcgctcccgcgtcccacagcctggccaagcagttgtactttcccctgcccggttccggctaccacctgctagcaccgctgtttcccaccagtctggtgcatcacgtccacgctctgctccgcgaagcgcgcttcggcgacgcggccaaggcggcacgcgaagcgcgcagccgccaggagtcatggccccacggattcagcgagtaccccaacctggcgatccagaagttcggcggtaccaagccgcagaacatcagtcagttgaacaacgagcgccgtggcgagaactggttgctgccatcgcttccgccgaactggcaaaggcagaatgtaaacgcgccgatgcggcactcttcggtcttcgagcatgacttcggaagaactcctgaagtatcccgcctaacccgtaccctgcagcgttttcttgccaagacagtccataacaacctcgccatccgccagcggcgtgcccaattggtggcgcaaatctgcgacgaagccctgcaatacgccgcccgtctgcgcgaactggagcccggctggagcgcaacccccgggtgccaactgcatgacgcggagcagctctggctcgatccgttgcgcgcacagaccgatgagacgttcttgcagcgccgactacgaggtgactggcctgccgaggtcggaaatcgcttcgccaactggctgaaccgggcggtcagcagcgacagtcagatactgggtagcccggaagccgcccaatggagccaggagctgagcaaggaactgacgatgttcaaggagatactcgaagatgagcgtgactga

SEQ ID NO: 310 - DNA, 984 bp, Pseudomonas aeruginosa UCBPP-PA14
  misc_feature (1)..(984): Cas5
atgagcgtgactgatcccgaggcgctgctgttgctgccacgcctgtccatccagaacgccaacgccatttccagccccttgacctggggtttcccttcgcccggcgctttcaccggattcgtccatgccttgcagcgtcgagtcggaatctccctcgatatcgaactggacggtgtcggcatcgtctgtcaccgcttcgaagcgcagatatcgcaaccggccggcaagcgcaccaaggtcttcaacctgacccgcaatccgctgaaccgcgacggctccaccgcagccatcgtcgaagaaggtcgcgcccatctggaggtcagtctgctgctcggagtgcatggcgatggtctggacgatcaccccgcacaggaaatcgccaggcaggtacaggagcaggctggcgccatgcgcctcgccggtggcagcatcctgccctggtgcaatgagcgcttcccggctccgaacgccgaactgctgatgctgggtggcagcgacgaacagcggcgcaagaaccagcgccggcttacccgccgcctgctccccggcttcgccctggtgagtcgcgaggcgttgttgcaacaacatctggaaaccttgcgcaccacgctccccgaagccaccacgctcgatgcactgctcgatctttgtcgaatcaacttcgagcctcctgcaacctcgtccgaagaagaagcatcgccgcccgatgcagcctggcaagtgcgcgacaagcccggctggctggtgccgatcccggctggctacaacgccctgtcacccctgtacctccccggcgaagtgcgaaatgcccgtgatagagaaacaccgctgcgcttcgtcgaaaacctcttcggtctgggcgaatggctcagcccccatcgcgtcgccgcgttatcggacctgctttggtatcaccacgccgagcctgacaaagggctctaccgctggagcacaccccgtttcgtcgaacacgccatcgcataa

SEQ ID NO: 311 - DNA, 1029 bp, Pseudomonas aeruginosa UCBPP-PA14
  misc_feature (1)..(1029): Cas7
atgtccaagccaatactgagcaccgcttccgtcctcgccttcgaacgtaagctcgacccttccgacgcccttatgagcgctggcgcctgggcgcaacgcgacgcctcgcaggaatggccggccgtgaccgtgcgcgagaagtccgtacgcggcaccatctccaaccgcctcaagaccaaggaccgtgacccggccaagctggacgcctcgatccagtcgcccaacctgcagacggtggacgtggccaacctgccgagcgacgccgacaccctcaaggtccgcttcaccctccgtgtgctcggcggcgccggaacaccgtctgcctgcaacgacgcggcctaccgtgacaagctgctgcaaacggtcgccacctacgtgaacgatcagggcttcgccgagctggctcgtcgttatgcgcacaacctggccaacgcccgcttcctgtggcgcaaccgggtgggcgcggaagcggtggaagtccgtatcaaccatatccgccagggcgaggtggctcgcgcctggcgcttcgacgccctggccatcggcttgcgcgacttcaaggccgacgccgaactggacgcgctcgccgaactgatcgccagcggtctctcaggcagtgggcatgtcctgctcgaagtggtcgccttcgcccgtatcggcgacggccaggaagtcttcccctcccaggaactgatcctcgacaaaggcgacaagaaaggccagaagagcaagaccctgtacagcgtacgcgatgccgcggccatccactcgcagaagatcggcaatgccctgcgcaccatcgatacgtggtatcccgacgaagatggcctcggccccatcgccgtggagccctacggctccgtcacatcccagggcaaagcctatcgccagcccaagcagaagctggacttctatacgctgctcgacaactgggtactgcgcgacgaggcgcccgccgtggagcaacagcattatgtgatcgccaacctgatccgtggcggcgtgttcggtgaagccgaagagaagtaa

SEQ ID NO: 312 - DNA, 564 bp, Pseudomonas aeruginosa UCBPP-PA14
  misc_feature (1)..(564): Cas6
atggaccactacctcgacattcgcttgcgaccggacccggaatttcccccggcgcaactcatgagcgtgctcttcggcaagctccaccaggccctggtggcacagggcggggacaggatcggcgtgagcttccccgacctcgacgaaagccgctcccggctgggcgagcgcctgcgcattcatgcctcggcggacgaccttcgtgccctgctcgcccggccctggctggaagggttgcgggaccatctgcaattcggagaaccggcagtcgtgcctcaccccacaccgtaccgtcaggtcagtcgggttcaggcgaaaagcaatccggaacgcctgcggcggcggctcatgcgccggcacgatctgagtgaggaggaggctcggaaacgcattcccgatacggtcgcgagagccttggacctgcccttcgtcacgctacgcagccagagcaccggacagcacttccgtctcttcatccgccacgggccgttgcaggtgacggcagaggaaggaggattcacctgttacgggttgagcaaaggaggtttcgttccctggttctga

SEQ ID NO: 313 - DNA, 1305 bp, Pseudomonas aeruginosa UCBPP-PA14
  misc_feature (1)..(1305): Cas8
atgacatctcctctgccaacccccacatggcaggagctgagacagtttatcgagagcttcatccaggagaggctgcagggcaagctggataagctgcagcctgacgaggacgataagcggcagaccctgctggccacacacagaagggaggcctggctggccgatgcagcacgccgggtgggacagctgcagctggtgacccacacactgaagccaatccaccctgacgcaaggggctctaatctgcacagcctgccacaggcaccaggacagcctggcctggccggctctcacgagctgggcgataggctggtgagcgacgtggtgggaaacgcagccgccctggacgtgtttaagttcctgtccctgcagtaccagggcaagaacctgctgaattggctgaccgaggatagcgccgaggccctgcaggccctgtccgacaatgcagagcaggcaagagagtggaggcaggcctttatcggaatcaccacagtgaagggagcaccagccagccactccctggccaagcagctgtactttcctctgccaggcagcggctatcacctgctggccccactgttccccacctccctggtgcaccacgtgcacgccctgctgagggaggcaaggttcggcgacgcagccaaggccgccagagaggcacgctcccggcaggagtcttggccacacggctttagcgagtaccctaatctggccatccagaagttcggcggcaccaagccccagaacatctcccagctgaacaatgagagaaggggcgagaactggctgctgccttctctgccccctaattggcagagacagaacgtgaatgccccaatgaggcactccagcgtgttcgagcacgatttcggccgcacccctgaggtgagcagactgaccaggacactgcagcggttcctggccaagacagtgcacaacaatctggccatcagacagaggagggcacagctggtggcacagatctgcgacgaggccctgcagtacgcagcaagactgagggagctggagccaggatggtccgccaccccaggctgtcagctgcacgacgcagagcagctgtggctggaccccctgagggcacagaccgacgagacatttctgcagagaaggctgaggggcgattggccagcagaagtgggaaacaggttcgcaaactggctgaatcgggccgtgagctccgactctcagatcctgggcagccccgaggcagcacagtggagccaggagctgtccaaggagctgaccatgttcaaggagatcctggaggacgagagggattaa

SEQ ID NO: 314 - DNA, 984 bp, Pseudomonas aeruginosa UCBPP-PA14
  misc_feature (1)..(984): Cas5
atgtctgtgacagaccctgaggccctgctgctgctgccaagactgagcatccagaacgccaatgccatcagctccccactgacctggggattcccttccccaggcgcctttacaggattcgtgcacgccctgcagcgccgggtgggcatctccctggatatcgagctggacggagtgggaatcgtgtgccaccgctttgaggcccagatctctcagccagccggcaagcggaccaaggtgttcaacctgacacgcaaccccctgaatcgggatggctctaccgcagcaatcgtggaggagggaagagcacacctggaggtgagcctgctgctgggagtgcacggcgacggcctggacgatcacccagcccaggagatcgcaagacaggtgcaggagcaggcaggagcaatgaggctggccggaggctctatcctgccatggtgcaacgagaggtttcccgcccctaatgcagagctgctgatgctgggaggcagcgacgagcagagaaggaagaatcagcgccggctgaccagaaggctgctgccaggattcgcactggtgagcagagaggccctgctgcagcagcacctggagacactgaggaccacactgcctgaggcaaccaccctggacgccctgctggacctgtgcagaatcaactttgagccacctgccacctctagcgaggaggaggccagcccacccgacgcagcctggcaggtgagggataagcctggatggctggtgccaatcccagcaggatacaacgccctgtcccctctgtatctgccaggcgaggtgcgcaatgccagagatagggagacacccctgcggtttgtggagaacctgttcggcctgggcgagtggctgtctcctcacagggtggccgccctgagcgatctgctgtggtatcaccacgccgagcctgacaagggcctgtacagatggagcaccccaaggttcgtggagcacgcaatcgcataa

SEQ ID NO: 315 - DNA, 1029 bp, Pseudomonas aeruginosa UCBPP-PA14
  misc_feature (1)..(1029): Cas7
atgagcaagcccatcctgtccaccgcctctgtgctggcctttgagcggaagctggacccttctgatgccctgatgagcgccggagcatgggcacagagagatgccagccaggagtggccagccgtgacagtgagagagaagtccgtgaggggcaccatctctaaccgcctgaagacaaaggaccgggaccccgcaaagctggatgccagcatccagtcccctaacctgcagaccgtggacgtggccaatctgccaagcgacgccgataccctgaaggtgcgcttcacactgcgggtgctgggaggagcaggaacaccatccgcctgcaatgatgccgcctatagagacaagctgctgcagaccgtggccacatacgtgaacgaccagggatttgcagagctggcccggagatacgcccacaacctggccaatgccaggttcctgtggaggaacagggtgggagcagaggcagtggaggtgcgcatcaatcacatcaggcagggagaggtggcaagggcatggcggtttgatgccctggccatcggcctgagagacttcaaggcagatgcagagctggacgccctggccgagctgatcgccagcggcctgtctggcagcggccacgtgctgctggaggtggtggcctttgccaggatcggcgacggccaggaggtgttcccttcccaggagctgatcctggacaagggcgataagaagggccagaagtccaagaccctgtactctgtgcgggatgcagcagcaatccacagccagaagatcggcaatgccctgagaaccatcgacacatggtatccagacgaggatggactgggaccaatcgcagtggagccttacggctctgtgaccagccagggcaaggcctataggcagcccaagcagaagctggacttctacacactgctggacaattgggtgctgagggatgaggcacctgcagtggagcagcagcactacgtgatcgccaacctgatcaggggaggcgtgttcggagaggcagaggagaagtaa

SEQ ID NO: 316 - DNA, 564 bp, Pseudomonas aeruginosa UCBPP-PA14
  misc_feature (1)..(564): Cas6
atggatcactatctggacatcagactgaggccagatcccgagtttccacccgcccagctgatgtctgtgctgttcggcaagctgcaccaggccctggtggcacagggaggcgaccggatcggcgtgtcttttccagacctggatgagtcccgctctcggctgggagagcggctgagaatccacgccagcgccgacgatctgagagccctgctggccaggccatggctggagggactgcgcgatcacctgcagttcggagagcctgcagtggtgcctcacccaaccccctacagacaggtgtctagggtgcaggccaagagcaacccagagcggctgaggcgccggctgatgagaaggcacgacctgagcgaggaggaggcaaggaagagaatccccgacacagtggcacgcgccctggatctgccctttgtgaccctgcggagccagtccacaggccagcactttcgcctgttcatcaggcacggaccactgcaggtgaccgcagaggagggaggcttcacatgctatggcctgtccaagggcggctttgtgccttggttctaa

SEQ ID NO: 317 - protein, 434 aa, Pseudomonas aeruginosa UCBPP-PA14
  misc_feature (1)..(434): Cas8
MTSPLPTPTWQELRQFIESFIQERLQGKLDKLQPDEDDKRQTLLATHRREAWLADAARRVGQLQLVTHTLKPIHPDARGSNLHSLPQAPGQPGLAGSHELGDRLVSDVVGNAAALDVFKFLSLQYQGKNLLNWLTEDSAEALQALSDNAEQAREWRQAFIGITTVKGAPASHSLAKQLYFPLPGSGYHLLAPLFPTSLVHHVHALLREARFGDAAKAAREARSRQESWPHGFSEYPNLAIQKFGGTKPQNISQLNNERRGENWLLPSLPPNWQRQNVNAPMRHSSVFEHDFGRTPEVSRLTRTLQRFLAKTVHNNLAIRQRRAQLVAQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 318 - protein, 327 aa, Pseudomonas aeruginosa UCBPP-PA14
  misc_feature (1)..(327): Cas5
MSVTDPEALLLLPRLSIQNANAISSPLTWGFPSPGAFTGFVHALQRRVGISLDIELDGVGIVCHRFEAQISQPAGKRTKVFNLTRNPLNRDGSTAAIVEEGRAHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVAALSDLLWYHHAEPDKGLYRWSTPRFVEHAIA

SEQ ID NO: 319 - protein, 342 aa, Pseudomonas aeruginosa UCBPP-PA14
  misc_feature (1)..(342): Cas7
MSKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNDQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 320 - protein, 187 aa, Pseudomonas aeruginosa UCBPP-PA14
  misc_feature (1)..(187): Cas6
MDHYLDIRLRPDPEFPPAQLMSVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARALDLPFVTLRSQSTGQHFRLFIRHGPLQVTAEEGGFTCYGLSKGGFVPWF

SEQ ID NO: 321 - DNA, 88 bp, Pseudomonas aeruginosa UCBPP-PA14
  misc_feature (1)..(88): CRISPR
gttcactgccgtgtaggcagctaagaaaaccacccgctaccaccggcagccgcaccggccgttcactgccgtgtaggcagctaagaaa

SEQ ID NO: 322 - DNA, 948 bp, Shewanella putrefaciens CN-32
  misc_feature (1)..(948): Cas7
atgcaaaaagtaacgggaattaaaagtgttgattttaaaattaaagcattaggtcatggcgtagtgaattggaatgggcctacaaccttaaccggtgatgacggtaaaacggttgataatcataccttgccaaaattgcgtggctacacaaacttgaccggtaaagtgaaagatgaaacgggctataaatataaaaaacaagcaactgacattaatttcaaagaaacgccactgtatataagtcaaaattgcattcgccatcatttatttcgtgaacaagcattcgatttacattatgccagtgacaaaaacctcaaaaatgtcctggcttcaattacagggttgatccgtggttacgtagtgccctcaagtcaatgcaaacgcaccagtccgctattgttggaagattttgttgatcaattgggtaacggcaattttgaacaatatgggcaggcaggagcaagagatagtacatcatttttttcaaagaccacttttggggatacagaatacatctcctatggctctattagtattgaacagttgcagtttatatcgttggataagaagtttgatcgtgctgcaatggttatcaaagaaggagagggcgaggttattgccgctgaactacagaattatattcagtcacttaaccccagcttaaatccacaagccatttttcattcaaactacgtcagaagaggcactatattcgaagagggagaatgcggcattttacttaatgatgatgcagtaaaagccttggttgctgaaacattagaacgcttagctaatttgtctattcgccaagctaaaggttatatgtacgtggatgacatcacggtggattacaacgacagccataaaatgatgcgtatcaagcgtgatgagtcagaaatcatcaatgagcagcatgcgccatttgcacagtatttttatgcaaaatag

SEQ ID NO: 323 - DNA, 1011 bp, Shewanella putrefaciens CN-32
  misc_feature (1)..(1011): Cas5
atgaaaataatcatagaatatgactcttgctggcgtaatgcctttttaggtggttcaaataatgaacctgtaccgaaaaaaggccgcgaatttttaggctcaatgacgagcttaaaaaaagaaggcaattttaaggtgtgtgaaaataccttagataccgtaatgggagtactaaatcgtttaattggcgaccaacgaaagctttatcaggcgcgcagtaaaatgtacgaatccgcttattacttcgaagcactggaagataaagtcagctttatagataagccgcagttgaccaatgaaatatcatttattcgtaatatgaatggcagtacggatcagaatgcatttactggaatgatcaaagtgtctgatcctgtttttacctctgaatattcacagcaattttggggcgtgttggctctcgatttcacgcagctctgtgattttattattaagcaatcacaagttgtaggatctattgagttaaacccgttaagtattatcaatcgcttggagagccttaatcaggaaaaagcactagaaaatagtgatgatttagcccaagtattaaaggtactaaatgaatactttcctgatattgaatatttaaataataaaggtttgatcacacctatcagcatttattgctcggcgctttaccttcagcttgcccgcttagaaactagctttaatatgaccacagctaaaacgaaagcaggggggattagtggaatttccaaacgaggtttcactaaaaaagacttcatggaccgatatacaacgggacccaaaaaaacaatctggggtaatccttttatcaaaaaagaaaagataaaagggcaaggtgaagtgacctccatgatgaccaaagcaagtggtcaattggaaattagtatcgatgtggatcgagacaaagcccaagaaatcaaaattttgattgaaaatgctggggtatcaagcttttaccttggaaaaaaagggctggcctatgtatcaaacattaagctttag

SEQ ID NO: 324 - DNA, 552 bp, Shewanella putrefaciens CN-32
  misc_feature (1)..(552): Cas6
atgaactcatatattgatatacggctgaagcctgatgccgaaatgcgggaggctgagctcagtagtaaagtatttactaaatttcacaaagcgttagtgacgctcaatagccataaaattggcattagctttccgcaaatgaaattaagcttagggcagttatttcgcattcatggtgatgcgagtttattgcatgatttacaaggcctggattggttaggccctttggcaggatattgtcaggttactgctgtttctgccgtgcctgatcacgtgcaatatcgtattgtttccgttaaacgcagtaatttaagtaaagcaaaattgaagcgtttaattgccagaggcagcatagataaagacggagagaaacggtacaaggtaaaaatgctcggccaaggatttgataatccatatcttgatctgtttagtagttccacagggcaggtatatcgtaaattctttgagtttagcgacattcaagctcacccccttgatggtgagtttgatagttatggtcttagcaaaaccgctacagtaccttggttttaa

SEQ ID NO: 325 - DNA, 948 bp, Shewanella putrefaciens CN-32
  misc_feature (1)..(948): Cas7
atgcagaaggtgaccggcatcaagtccgtggacttcaagatcaaggccctgggccacggcgtggtgaactggaatggccccaccacactgacaggcgacgatggcaagaccgtggacaatcacacactgcctaagctgagaggctacaccaacctgacaggcaaggtgaaggatgagaccggctacaagtataagaagcaggccaccgacatcaatttcaaggagacacctctgtacatcagccagaactgcatccggcaccacctgtttagagagcaggccttcgatctgcactatgcctctgacaagaacctgaagaatgtgctggccagcatcaccggactgatcaggggatacgtggtgccaagctcccagtgtaagcggacatcccccctgctgctggaggattttgtggaccagctgggcaacggcaatttcgagcagtacggacaggcaggagcaagggatagcacctccttctttagcaagaccacattcggcgacacagagtacatctcctatggctctatcagcatcgagcagctgcagtttatcagcctggataagaagttcgaccgcgccgccatggtcatcaaggagggagagggagaagtgatcgcagcagagctgcagaattacatccagagcctgaacccctccctgaatcctcaggccatctttcactctaactatgtgcggagaggcaccatcttcgaggagggcgagtgcggcatcctgctgaatgacgatgcagtgaaggccctggtggcagagaccctggagagactggccaacctgtccatcaggcaggccaagggctacatgtatgtggacgatatcacagtggattacaatgactctcacaagatgatgcggatcaagagagatgagagcgagatcatcaacgagcagcacgccccttttgcccagtacttctatgcaaagtaa

SEQ ID NO: 326 - DNA, 1011 bp, Shewanella putrefaciens CN-32
  misc_feature (1)..(1011): Cas5
atgaagatcatcatcgagtacgactcctgctggagaaacgccttcctgggcggctctaacaatgagcctgtgccaaagaagggcagggagtttctgggcagcatgacatccctgaagaaggagggcaacttcaaggtgtgcgagaataccctggatacagtgatgggcgtgctgaacaggctgatcggcgaccagaggaagctgtaccaggcacggtccaagatgtatgagtctgcctactattttgaggccctggaggataaggtgagcttcatcgacaagccccagctgaccaatgagatctcctttatcagaaacatgaatggctctaccgatcagaacgccttcacaggcatgatcaaggtgagcgaccccgtgttcacctctgagtacagccagcagttctggggcgtgctggccctggacttcacccagctgtgcgacttcatcatcaagcagagccaggtggtgggctccatcgagctgaaccccctgtctatcatcaataggctggagagcctgaaccaggagaaggccctggagaatagcgacgatctggcccaggtgctgaaggtgctgaacgagtactttccagacatcgagtatctgaacaataagggcctgatcacccccatcagcatctactgttccgccctgtatctgcagctggcccgcctggagacctccttcaatatgaccacagccaagacaaaggccggcggcatctccggcatctctaagagaggctttaccaagaaggatttcatggacaggtacaccacaggccccaagaagacaatctggggcaacccttttatcaagaaggagaagatcaagggccagggcgaggtgacctctatgatgacaaaggccagcggccagctggagatctccatcgacgtggatcgggacaaggcccaggagatcaagatcctgatcgagaatgccggcgtgtcctctttctacctgggcaagaagggcctggcctatgtgagcaacatcaagctgtaa

SEQ ID NO: 327 - DNA, 552 bp, Shewanella putrefaciens CN-32
  misc_feature (1)..(552): Cas6
atgaacagctatatcgatatccgcctgaagccagacgcagagatgagggaggcagagctgtctagcaaggtgtttaccaagttccacaaggccctggtgacactgaactcccacaagatcggcatctcttttccacagatgaagctgtccctgggccagctgttcagaatccacggcgatgcctctctgctgcacgatctgcagggcctggactggctgggacctctggccggatactgccaggtgaccgccgtgagcgccgtgccagaccacgtgcagtataggatcgtgtccgtgaagcggagcaatctgagcaaggccaagctgaagaggctgatcgcccgcggcagcatcgacaaggatggcgagaagcggtacaaggtgaagatgctgggccagggctttgataacccatacctggacctgttctcctctagcaccggccaggtgtatagaaagttctttgagttttccgatatccaggcccacccactggatggcgagttcgactcctatggcctgtctaagaccgcaacagtgccatggttctaa

SEQ ID NO: 328 - protein, 315 aa, Shewanella putrefaciens CN-32
  misc_feature (1)..(315): Cas7
MQKVTGIKSVDFKIKALGHGVVNWNGPTTLTGDDGKTVDNHTLPKLRGYTNLTGKVKDETGYKYKKQATDINFKETPLYISQNCIRHHLFREQAFDLHYASDKNLKNVLASITGLIRGYVVPSSQCKRTSPLLLEDFVDQLGNGNFEQYGQAGARDSTSFFSKTTFGDTEYISYGSISIEQLQFISLDKKFDRAAMVIKEGEGEVIAAELQNYIQSLNPSLNPQAIFHSNYVRRGTIFEEGECGILLNDDAVKALVAETLERLANLSIRQAKGYMYVDDITVDYNDSHKMMRIKRDESEIINEQHAPFAQYFYAK

SEQ ID NO: 329 - protein, 336 aa, Shewanella putrefaciens CN-32
  misc_feature (1)..(336): Cas5
MKIIIEYDSCWRNAFLGGSNNEPVPKKGREFLGSMTSLKKEGNFKVCENTLDTVMGVLNRLIGDQRKLYQARSKMYESAYYFEALEDKVSFIDKPQLTNEISFIRNMNGSTDQNAFTGMIKVSDPVFTSEYSQQFWGVLALDFTQLCDFIIKQSQVVGSIELNPLSIINRLESLNQEKALENSDDLAQVLKVLNEYFPDIEYLNNKGLITPISIYCSALYLQLARLETSFNMTTAKTKAGGISGISKRGFTKKDFMDRYTTGPKKTIWGNPFIKKEKIKGQGEVTSMMTKASGQLEISIDVDRDKAQEIKILIENAGVSSFYLGKKGLAYVSNIKL

SEQ ID NO: 330 - protein, 183 aa, Shewanella putrefaciens CN-32
  misc_feature (1)..(183): Cas6
MNSYIDIRLKPDAEMREAELSSKVFTKFHKALVTLNSHKIGISFPQMKLSLGQLFRIHGDASLLHDLQGLDWLGPLAGYCQVTAVSAVPDHVQYRIVSVKRSNLSKAKLKRLIARGSIDKDGEKRYKVKMLGQGFDNPYLDLFSSSTGQVYRKFFEFSDIQAHPLDGEFDSYGLSKTATVPWF

SEQ ID NO: 331 - DNA, 88 bp, Shewanella putrefaciens CN-32
  misc_feature (1)..(88): CRISPR
gttcaccgccgcacaggcggcttagaaatcaaccaaatcataaattgcgcgaccacattggttcaccgccgcacaggcggcttagaaa

SEQ ID NO: 332 - DNA, 990 bp, Acinetobacter sp. 869535
  misc_feature (1)..(990): Cas7
atggctaaagtaacaggcgtaaaaagcgtagattttaaaattacagcatatggttatggggtggtgaattggaatggtccaacgtcactgacaggtaatgatggtaagacagtggataaccacacattacctaaacttcgtggtttcagtaatttatcaggtagagtcaaagaagaaacaggctacaaataccgtaaagaagcatcagacattgattttaacgaaacgcctttatatatcagccaaaattgtattcgccatcacttattccgtgaccaatcttttgatttacattatgcaaaagataagaatttgattgatgttctagcatctattacgggattaatccgtggttatgttgtgccatcgagtcaatgtaaacgtacaagtccacttttgattactgattttattgatcagttgggtaatggcaactttgaacagctttcgaatgcaagttcaagtgaagaaattacgcaagatgatggctcaaaaacatataaacgtggtgaaaactcaatcttctctaaaacgacctttggtgataccgaatatatcgcttatggctcgattagtattgaacaattgcagttcatttcactcgataaaaaatttgaccgtgcttcgatgattattaaagaaggagaaggtgaaaagattgcagagcgagtacaggaatttattaagagccttgatccatcgaaagaaccaaaagcaattttccataaaaattatgtccgtaagggaacaatctttaatgaaggtgaagtgggtattttactcgacaacactgcaattgatattttagtcaaagaaacgctttcaatgcttgaagaactcgttattaagcaagccaaaggttatatgtgcgcagatacggtagaagtggattataacgacagtcataaaatgatgcgtattaaacgcaatccagaccaagccaatcctgagctacaacaagattatgcagtttattttgaagcccaataa

SEQ ID NO: 333 - DNA, 1014 bp, Acinetobacter sp. 869535
  misc_feature (1)..(1014): Cas5
atgcaaatcattattgaatatgaatcctcttggcgaaattcatttttagatggctctaataatgaacccttgcctaaaggcggacgtaattttattgcttcaatgacaacattaaagcaagaaggcaattacaaaaagcgtagtatttcaaaagataccgtcatgggcattctaaatcgtttgattggtgatcaacgtaaactttatcaggcacgacaggatgaaaattattattttactgaagttgaaaaagtacttcaggagaatgatattgtcgatcacgctttaaatagtaacgagatggtttatatccgtaatgtttcagggagtacagatcaaaattcatttacaggtgaaattaaagcaaatgatccatcctttagctcgagtttttcagctgaactttggggtgttttatggcttaatttatctgaagtttccaaatttattttggatgagtcatattctgtgacctactctgaagttttagatccaattacggtgtgtaatcgtattgaagttttgagtgcagaaaaaccaatggatctgacggaggatattcaagctgtactagactatttattgaatcatttccccgatacaaagtatttgactgcaaaaaagcaattacctttgatcagtatttatgcctctgctttatatcttcaaattacaagattatctcaaagatatgatctctcaactgtcttaacaaaaagtggcggactgagtggaatctcaaagcgtggatttaccaaaaaagattttatggatcgttatacgacaggaagtaaaaagctcatttggggcaatccctatttattgaaagaaaagaaaaaaggtgagggtgaaatcgtatctgttttaaccaaagctagtggaaagctcattataaatttgaatatttctaaagaacaagcaagagatttagaagaaaaaattgaaaatgcaggggtttcatctttttacttaggtaaaaagggcttggcttatgtcacggatattagaccttaa

SEQ ID NO: 334 - DNA, 603 bp, Acinetobacter sp. 869535
  misc_feature (1)..(603): Cas6
atgaactattacattgaagtaacattaatggaaaatgatcaattttctccttatgaattatggtcacaactttatcctcaattgcatcttgcattggttgaagccaaaaatgctgacaataaagtgaatattggattttcgttccctcaataccgctttcatcaagataaaggtgttggatttataggtacaaaattacgtttatttgctgagtctgaagctgatttgaagaaactggacattcgacgttggcttgagcgtttagaagattatgtacatgtcacttctattcgtgaagtacctaatgatattaagaactatgccatttataagcgtaagcaagtgaaaaccaatgcacaacgtttggcgcgtcaccgtgtaaaacgtggggatattggctttgatgaggcattagccagatacagcaatgtagttacgacaaccaacatgccttatattgaaatgaaaagcctgagcacttcagatcagcaaagtgaaaaacgttttaaattgtttatcgaaaagcaatctgctgaaaaatctgaaactcaggtttttagcacttatggattaagttcggtgtcatctgtaccagaattttaa

SEQ ID NO: 335 - DNA, 990 bp, Acinetobacter sp. 869535
  misc_feature (1)..(990): Cas7
atggccaaggtgacaggcgtgaagtccgtggacttcaagatcaccgcctacggctatggcgtggtgaactggaatggcccaacaagcctgaccggcaatgacggcaagacagtggataaccacaccctgcccaagctgagaggcttctccaatctgtctggcagggtgaaggaggagacaggctacaagtataggaaggaggcctctgacatcgacttcaacgagacccctctgtacatcagccagaactgcatcaggcaccacctgtttcgcgaccagtccttcgatctgcactatgccaaggacaagaacctgatcgatgtgctggcctctatcaccggactgatcaggggatacgtggtgccaagctcccagtgtaagcggacaagccccctgctgatcaccgacttcatcgatcagctgggcaacggcaattttgagcagctgagcaatgcctctagctccgaggagatcacacaggacgatggctccaagacctacaagcgcggcgagaacagcatcttttccaagaccacattcggcgacaccgagtacatcgcctatggctccatctctatcgagcagctgcagtttatctccctggacaagaagttcgatagagcctctatgatcatcaaggagggcgagggcgagaagatcgccgagagggtgcaggagttcatcaagagcctggaccccagcaaggagcctaaggccatcttccacaagaattacgtgcggaagggcacaatctttaacgagggcgaagtgggcatcctgctggacaatacagccatcgatatcctggtgaaggagaccctgagcatgctggaggagctggtcatcaagcaggccaagggctacatgtgcgccgacaccgtggaggtggactataacgattcccacaagatgatgaggatcaagcgcaatccagaccaggccaaccccgagctgcagcaggattacgccgtgtatttcgaggcacagtaa

SEQ ID NO: 336 - DNA, 1014 bp, Acinetobacter sp. 869535
  misc_feature (1)..(1014): Cas5
atgcagatcatcatcgagtacgagagctcctggcgcaactccttcctggacggctctaacaatgagcctctgccaaagggcggccggaacttcatcgcctccatgacaaccctgaagcaggagggcaactacaagaagcggagcatctctaaggatacagtgatgggcatcctgaacaggctgatcggcgaccagcgcaagctgtatcaggcccggcaggatgagaattactatttcaccgaggtggagaaggtgctgcaggagaacgacatcgtggatcacgccctgaacagcaatgagatggtgtacatcagaaacgtgagcggcagcacagaccagaactccttcaccggagagatcaaggccaatgatcccagcttttctagctccttctccgccgagctgtggggcgtgctgtggctgaacctgtccgaggtgtctaagtttatcctggacgagtcttacagcgtgacatattctgaggtgctggaccccatcaccgtgtgcaatcggatcgaggtgctgagcgccgagaagcctatggacctgaccgaggatatccaggccgtgctggactacctgctgaaccactttccagatacaaagtatctgaccgccaagaagcagctgcccctgatcagcatctacgcctccgccctgtatctgcagatcacacggctgtctcagagatacgacctgagcacagtgctgaccaagtccggcggactgagcggcatctccaagagaggctttaccaagaaggacttcatggataggtacacaaccggcagcaagaagctgatctggggcaatccttatctgctgaaggagaagaagaagggcgagggcgagatcgtgtctgtgctgacaaaggccagcggcaagctgatcatcaacctgaatatctccaaggagcaggccagagacctggaggagaagatcgagaacgccggcgtgtctagcttctacctgggcaagaagggcctggcctatgtgaccgatatcaggccataa

SEQ ID NO: 337 - DNA, 603 bp, Acinetobacter sp. 869535
  misc_feature (1)..(603): Cas6
atgaattactatatcgaggtgaccctgatggagaacgatcagttttctccttacgagctgtggagccagctgtatccacagctgcacctggccctggtggaggcaaagaacgccgacaataaggtgaacatcggcttctcctttccccagtaccgctttcaccaggataagggcgtgggcttcatcggcaccaagctgcggctgtttgccgagtccgaggccgacctgaagaagctggatatccggcggtggctggagagactggaggactatgtgcacgtgacatctatcagggaggtgcccaatgatatcaagaactacgccatctataagaggaagcaggtgaagaccaacgcacagcgcctggccaggcacagagtgaagcggggcgacatcggcttcgatgaggccctggcccgctacagcaatgtggtgaccacaaccaacatgccttatatcgagatgaagagcctgtccacatctgaccagcagtctgagaagcggtttaagctgttcatcgagaagcagtccgccgagaagtctgagacacaggtgttcagcacctacggcctgtctagcgtgtcctctgtgcctgagttttaa

SEQ ID NO: 338 - protein, 329 aa, Acinetobacter sp. 869535
  misc_feature (1)..(329): Cas7
MAKVTGVKSVDFKITAYGYGVVNWNGPTSLTGNDGKTVDNHTLPKLRGFSNLSGRVKEETGYKYRKEASDIDFNETPLYISQNCIRHHLFRDQSFDLHYAKDKNLIDVLASITGLIRGYVVPSSQCKRTSPLLITDFIDQLGNGNFEQLSNASSSEEITQDDGSKTYKRGENSIFSKTTFGDTEYIAYGSISIEQLQFISLDKKFDRASMIIKEGEGEKIAERVQEFIKSLDPSKEPKAIFHKNYVRKGTIFNEGEVGILLDNTAIDILVKETLSMLEELVIKQAKGYMCADTVEVDYNDSHKMMRIKRNPDQANPELQQDYAVYFEAQ

SEQ ID NO: 339 - protein, 337 aa, Acinetobacter sp. 869535
  misc_feature (1)..(337): Cas5
MQIIIEYESSWRNSFLDGSNNEPLPKGGRNFIASMTTLKQEGNYKKRSISKDTVMGILNRLIGDQRKLYQARQDENYYFTEVEKVLQENDIVDHALNSNEMVYIRNVSGSTDQNSFTGEIKANDPSFSSSFSAELWGVLWLNLSEVSKFILDESYSVTYSEVLDPITVCNRIEVLSAEKPMDLTEDIQAVLDYLLNHFPDTKYLTAKKQLPLISIYASALYLQITRLSQRYDLSTVLTKSGGLSGISKRGFTKKDFMDRYTTGSKKLIWGNPYLLKEKKKGEGEIVSVLTKASGKLIINLNISKEQARDLEEKIENAGVSSFYLGKKGLAYVTDIRP

SEQ ID NO: 340 - protein, 200 aa, Acinetobacter sp. 869535
  misc_feature (1)..(200): Cas6
MNYYIEVTLMENDQFSPYELWSQLYPQLHLALVEAKNADNKVNIGFSFPQYRFHQDKGVGFIGTKLRLFAESEADLKKLDIRRWLERLEDYVHVTSIREVPNDIKNYAIYKRKQVKTNAQRLARHRVKRGDIGFDEALARYSNVVTTTNMPYIEMKSLSTSDQQSEKRFKLFIEKQSAEKSETQVFSTYGLSSVSSVPEF

SEQ ID NO: 341 - DNA, 88 bp, Acinetobacter sp. 869535
  misc_feature (1)..(88): CRISPR
gttcactgccatataggcagcttagaaaatcgttttttcatacgagattcgaaacggacagttcactgccatataggcagcttagaaa

SEQ ID NO: 342 - DNA, 948 bp, Vibrio cholerae HE48
  misc_feature (1)..(948): Cas7
atgcaaaaagtaacaggaattaaaagtgtagattttaaaattaaagcattaggtcatggtgtagtgaattggaatgggcctacaaccttaactggagatgatggtaaaacagtcgataatcataccttgccaaaattgcgcggctataccaacttaaccggtaaagtgaaagatgaaactggctataaatataaaaaacaagcaactgacattaatttcaaagaaacaccactgtatataagtcaaaattgtattcgacatcatttgtttcgtgagcaagcttttgatttacattttgctagtgacaaaaacctaaaaaacgttctggcttcaattacggggttgatccgaggttatgtagttcctgcaagtcaatgtaagcgcaccagtccactattgttagaagattttgttgatcaattggggaatggcaactttgaacaatatggacaggcaggtgctagagatagcacatcatttttttcaaagactacttttggtgatactgaatatatctcttatggttccatcagtattgaacaactgcaatttatatcgttggataagaagtttgatcgtgccgcaatggttatcaaagagggcgagggtgaggttattgccgctgaactacaaagctatattaagtcacttaatcctagcttaaacccacaggcgatttttcacaaaaactacgtcagaagaggcacaatatttgaagagggagagtgtggcattttacttaatgatgacgcagtgaaagctttagttgacgaaacactagatcgtttagctaatttgtctattcgtcaagcgaaaggttatatgtatgttgacgaaattacagttgattataacgatagtcataaaatgatgcgcattaagcgtgatgaatcagaaatttcagagcaacctaatagcaattttgcaatttacttttatgcaaagtag

SEQ ID NO: 343 - DNA, 1056 bp, Vibrio cholerae HE48
  misc_feature (1)..(1056): Cas5
atgaaaatcttaattgattatgaagcatcttggcgtaattcatttttggatggtaataatgatgaaccattacccgcgaaaggtagaacatttatagctgcaagctccagtttaaatgatcgtgaaaagccggataattttaaattagttgacgtaacgaagcagactgtatttggaatcctgtgtcgattgatcggtgatcaaaggaaattataccaatcaaagcaaagtgatacatatttcctgaaagggttggaagactttataacgttcaaagatatacctgtgttgaccaatgaaattgtatatattcggaatatgactggcagctttgacagagagtcatatactggagtgataaatacaaatcattggttgtttaaatctgttttttctaatcaactttggagtcttgcttttactgatctaaatgcactggtcagttttatagttgaagagattgaagttgctaatgatcaagagttcgatcctagggatgttattgatcgatttaataaatttaaaagtattggtatcagtaaaattgatgaattaggcttgtcagaaaatcgtttatataaggctgttgacattctttatgatgctaaccttaatgcaaatgtaaggtctttgtttcccagtatgaaaaagagcttttctgatattgattatattaaatcagataaagttgatgtcagagcattatattgctctgcactatatttaaaattagtcaggcttaatctcggtggtatacctataccgagtaatattaaagggttttctgtggctggtttgacaccaaaagactttatgggcagtttcacacaaggtaaaaagaaggtttacggtaatccttatctaaaaaaggaaatgataaaagggcaaggagaagtgacatctatgctgaccaaagccagtgggcagttggaaattactattgacgtggatcgagacaaagcacaagaaatcaaaacgttgattgaaaatgctggggtatcaagcttttaccttggaaaaaaagggctggcttacgtttcaagcattcgactttag

SEQ ID NO: 344 - DNA, 552 bp, Vibrio cholerae HE48
  misc_feature (1)..(552): Cas6
atggacgcatacattgatatacggctgatgcctgatgctgaaatgcgcgaggcagaattaagtagtaaagtctttattaaattccacaaagcactggtgaagttacagagcaataaaattggtattagctttccagaagcaaatattaagctagggcgattatttcgtttacacggtgaagtgagcgcattgcatgatttgcaggggttaaattggttaggacctttggcaggatattgcaagattactacggttactcatgtgccagaccaagtggaatatcgcatcatttcagttaaacgcagcaatttaagcaaagcaaaattagcgcgtttaattgctagaggtagcatagataaagatggtgagaaacgttacaaagtaaaaatgcttcgccaagggtttgataatccataccttgatctgtctagcagttcaacagggcaggtgtaccgaaaattctttgagtttagtgatattcaagctgagccagttgatggtgagtttgatagttatggtctaagcaaaacagcaactgtaccttggttttaa

SEQ ID NO: 345 - DNA, 948 bp, Vibrio cholerae HE48
  misc_feature (1)..(948): Cas7
atgcagaaggtgaccggcatcaagtccgtggacttcaagatcaaggccctgggccacggcgtggtgaactggaatggccctaccacactgacaggcgacgatggcaagaccgtggataatcacacactgccaaagctgaggggctataccaacctgacaggcaaggtgaaggacgagaccggctacaagtataagaagcaggccaccgatatcaacttcaaggagacacctctgtacatcagccagaactgcatcaggcaccacctgttccgcgagcaggcctttgacctgcacttcgcctctgataagaatctgaagaacgtgctggccagcatcaccggactgatcaggggctatgtggtgccagccagccagtgtaagagaacatcccccctgctgctggaggattttgtggaccagctgggcaacggcaatttcgagcagtacggacaggcaggagcaagggactccacctctttcttttccaagaccacattcggcgatacagagtacatctcttatggcagcatctccatcgagcagctgcagtttatcagcctggacaagaagttcgatcgggccgccatggtcatcaaggagggagagggagaagtgatcgcagcagagctgcagagctacatcaagtccctgaatccatctctgaacccccaggccatctttcacaagaactatgtgcggagaggcaccatcttcgaggagggcgagtgcggcatcctgctgaatgacgatgccgtgaaggccctggtggacgagaccctggatcggctggccaacctgtccatcagacaggccaagggctacatgtatgtggacgagatcacagtggattacaatgacagccacaagatgatgcggatcaagagagatgagtctgagatcagcgagcagccaaactccaattttgccatctacttctatgcaaagtaa

SEQ ID NO: 346 - DNA, 1056 bp, Vibrio cholerae HE48
  misc_feature (1)..(1056): Cas5
atgaagatcctgatcgactacgaggcctcttggagaaacagctttctggacggcaacaatgatgagcctctgccagccaagggcaggacattcatcgccgccagctcctctctgaatgaccgcgagaagccagataactttaagctggtggatgtgaccaagcagacagtgttcggcatcctgtgcaggctgatcggcgaccagcgcaagctgtaccagtctaagcagagcgatacctattttctgaagggcctggaggactttatcaccttcaaggatatccccgtgctgacaaatgagatcgtgtacatcaggaacatgacaggctccttcgaccgcgagtcttataccggcgtgatcaacacaaatcactggctgtttaagtccgtgttctctaatcagctgtggagcctggcctttaccgacctgaacgccctggtgtccttcatcgtggaggagatcgaggtggccaatgatcaggagttcgatccccgggacgtgatcgatcggttcaacaagttcaagtccatcggcatctctaagatcgacgagctgggcctgagcgagaacaggctgtacaaggccgtggacatcctgtatgatgccaacctgaatgccaacgtgcgcagcctgtttccttccatgaagaagagcttctccgacatcgattacatcaagtctgacaaggtggatgtgcgggccctgtactgcagcgccctgtatctgaagctggtgagactgaatctgggcggcatccccatcccttctaacatcaagggctttagcgtggccggcctgaccccaaaggactttatgggctccttcacacagggcaagaagaaggtgtacggcaatccctatctgaagaaggagatgatcaagggccagggcgaggtgacctccatgctgacaaaggcctctggccagctggagatcaccatcgacgtggatagagacaaggcccaggagatcaagacactgatcgagaacgccggcgtgagctccttctacctgggcaagaagggcctggcctacgtgagcagcatcaggctgtaa

SEQ ID NO: 347 - DNA, 552 bp, Vibrio cholerae HE48
  misc_feature (1)..(552): Cas6
atggacgcctacatcgatatccggctgatgccagatgccgagatgagagaggccgagctgagctccaaggtgtttatcaagttccacaaggccctggtgaagctgcagtccaataagatcggcatctcttttcctgaggccaacatcaagctgggcaggctgttccgcctgcacggagaggtgtccgccctgcacgacctgcagggcctgaattggctgggaccactggccggctactgcaagatcaccacagtgacccacgtgcccgatcaggtggagtataggatcatctctgtgaagcggagcaacctgtctaaggcaaagctggccaggctgatcgcaagaggctccatcgacaaggatggcgagaagaggtataaggtgaagatgctgcgccagggctttgacaatccttacctggatctgtctagctcctctaccggccaggtgtatcggaagttctttgagtttagcgacatccaggcagagccagtggacggagagttcgatagctacggcctgtccaagaccgcaacagtgccttggttctaa

SEQ ID NO: 348 - protein, 315 aa, Vibrio cholerae HE48
  misc_feature (1)..(315): Cas7
MQKVTGIKSVDFKIKALGHGVVNWNGPTTLTGDDGKTVDNHTLPKLRGYTNLTGKVKDETGYKYKKQATDINFKETPLYISQNCIRHHLFREQAFDLHFASDKNLKNVLASITGLIRGYVVPASQCKRTSPLLLEDFVDQLGNGNFEQYGQAGARDSTSFFSKTTFGDTEYISYGSISIEQLQFISLDKKFDRAAMVIKEGEGEVIAAELQSYIKSLNPSLNPQAIFHKNYVRRGTIFEEGECGILLNDDAVKALVDETLDRLANLSIRQAKGYMYVDEITVDYNDSHKMMRIKRDESEISEQPNSNFAIYFYAK

SEQ ID NO: 349 - protein, 351 aa, Vibrio cholerae HE48
  misc_feature (1)..(351): Cas5
MKILIDYEASWRNSFLDGNNDEPLPAKGRTFIAASSSLNDREKPDNFKLVDVTKQTVFGILCRLIGDQRKLYQSKQSDTYFLKGLEDFITFKDIPVLTNEIVYIRNMTGSFDRESYTGVINTNHWLFKSVFSNQLWSLAFTDLNALVSFIVEEIEVANDQEFDPRDVIDRFNKFKSIGISKIDELGLSENRLYKAVDILYDANLNANVRSLFPSMKKSFSDIDYIKSDKVDVRALYCSALYLKLVRLNLGGIPIPSNIKGFSVAGLTPKDFMGSFTQGKKKVYGNPYLKKEMIKGQGEVTSMLTKASGQLEITIDVDRDKAQEIKTLIENAGVSSFYLGKKGLAYVSSIRL

SEQ ID NO: 350 - protein, 183 aa, Vibrio cholerae HE48
  misc_feature (1)..(183): Cas6
MDAYIDIRLMPDAEMREAELSSKVFIKFHKALVKLQSNKIGISFPEANIKLGRLFRLHGEVSALHDLQGLNWLGPLAGYCKITTVTHVPDQVEYRIISVKRSNLSKAKLARLIARGSIDKDGEKRYKVKMLRQGFDNPYLDLSSSSTGQVYRKFFEFSDIQAEPVDGEFDSYGLSKTATVPWF

SEQ ID NO: 351 - DNA, 88 bp, Vibrio cholerae HE48
  misc_feature (1)..(88): CRISPR
gttcactgccgcacaggcagcttagaaataaccggaggcgtacactcgatagaggcagcggttcactgccgcacaggcagcttagaaa

SEQ ID NO: 352 - DNA, 3736 bp, Artificial Sequence
  Synthetic: CRISPR
taatacgactcactataggggaattgtgagcggataacaattcccctgtagaaataattttgtttaactttaataaggagatataccatgggctagcgagttccccgcgccagcggggataaaccgccagtgataagtggaatgccatgtgggctgtcgagttccccgcgccagcggggataaaccggagctcgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 353 - DNA, 4118 bp, Artificial Sequence
  Synthetic: CRISPR
taatacgactcactataggggaattgtgagcggataacaattcccctgtagaaataattttgtttaactttaataaggagatataccatggattagctgatctttaataataaggaaatgttacattaaggttggtgggttgtttttatgggaaaaaatgctttaagaacaaatgtatacttttagagagttccccgcgccagcggggataaaccgcaaacacagcatggacgacagccaggtacctagagttccccgcgccagcggggataaaccgcaaacacagcatggacgacagccaggtacctagagttccccgcgccagcggggataaaccgcaaacacagcatggacgacagccaggtacctagagttccccgcgccagcggggataaaccgaaaacaaaaggctcagtcggaagactgggccttttgttttaaccccttggggcctctaaacgggtcttgaggggttttttgctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 354 - DNA, 3797 bp, Artificial Sequence
  Synthetic: CRISPR(J3/L3)
taatacgactcactataggggaattgtgagcggataacaattcccctgtagaaataattttgtttaactttaataaggagatataccatgggctagcgagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccggagctcgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 355 - DNA, 3797 bp, Artificial Sequence
  Synthetic: CRISPR(Hsa07)
taatacgactcactataggggaattgtgagcggataacaattcccctgtagaaataattttgtttaactttaataaggagatataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 356 - DNA, 7967 bp, Artificial Sequence
  Synthetic: His6-MBP-TEV-Cas8
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaactagtaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatgttttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaactaaggaggtccgctatgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatgcaatgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgataataacattggaagtggataacggatccgaattcgagcgccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 357 - DNA, 6435 bp, Artificial Sequence
  Synthetic: StrepII-HRV3C-Cse2_Cas7_Cas5_Cas6
taatacgactcactataggggaattgtgagcggataacaattcccctgtagaaataattttgtttaactttaataaggagatataccatggcaagctggagccacccgcagttcgaaaagggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 358 - DNA, 7933 bp, Artificial Sequence
  Synthetic: Cas8_His6HRV3CCse2_Cas7_Cas5_Cas6
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 359 - DNA, 8644 bp, Artificial Sequence
  Synthetic: FokI30aaCas8_His6HRV3CCse2_Cas7_Cas5_Cas6
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctccgaaaaaaaagcgcaaagtgggtggctctcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 360 - DNA, 8710 bp, Artificial Sequence
  Synthetic: FokI30aaCas8_His6HRV3CCse2_Cas7_Cas5_NLSCas6
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctccgaaaaaaaagcgcaaagtgggtggctctcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaattaataaaggaggtatataatgccaaagaaaaaacgtaaggttggcggtagcatgtacctcagcaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 361 - DNA, 8687 bp, Artificial Sequence
  Synthetic: FokI30aaCas8_His6HRV3CCse2_Cas7NLS_Cas5_Cas6
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctccgaaaaaaaagcgcaaagtgggtggctctcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgggcggtagcccaaagaaaaaacgtaaggtttgataaaggaggtatataatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 362 - DNA, 8614 bp, Artificial Sequence
  Synthetic: Cas8_His6HRV3CCse2_Cas7_Cas5_Cas620aaFokI
ttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaaggaaacctttctatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgaacatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtcgggctcagaaacgccggggacatcggaatccgccacacctgagtcgggtggttctggtcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaactttggtggctctccgaaaaaaaagcgcaaagtgtaataactgcaggcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatc

SEQ ID NO: 363 - DNA, 12975 bp, Artificial Sequence
  Synthetic: Polypromoter, Cas5_Cas3_Cse2_Cas7_Cas6_Cas8_CRISPR(J3)
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 364 - DNA, 12975 bp, Artificial Sequence
  Synthetic: Polypromoter, Cas5_Cas3_Cse2_Cas7_CRISPR(J3)_Cas6_Cas8
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgataataagatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 365 - DNA, 9499 bp, Artificial Sequence
  Synthetic: Polypromoter(EcoCO), CRISPR(J3/L3)_Cse2_Cas7_Cas5_Cas8_Cas6
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggcagatgaaattgatgcaatggcactgtatcgtgcatggcagcagctggataatggtagctgtgcacagattcgtcgtgttagcgaaccggatgaactgcgtgatattccggcattttatcgtctggttcagccgtttggttgggaaaatccgcgtcatcagcaggcactgctgcgtatggttttttgtctgagcgcaggtaaaaatgttattcgtcatcaggataaaaaaagcgaacagaccaccggtattagcctgggtcgtgcactggcaaatagcggtcgtattaatgaacgtcgtatttttcagctgattcgtgcagatcgtaccgcagatatggttcagctgcgtcgtctgctgacccatgcagaaccggttctggattggccgctgatggcacgtatgctgacctggtggggtaaacgtgaacgtcagcagctgctggaagattttgttctgaccaccaataaaaatgcctaataagcagaatgttatcaatgccatgcaggaattctagcataaccccttggggcctctaaacgggtcttgaggggttttttggttttagccagctggttgaagaactgctgaaaattatttgtgcatttcagctggataccggtctggaatatgcaaatagctacaattttgccaaaaaagataatacgactcactataggcccctgtagaaataattttgtttaactttaataaggagatataccatgagcaactttattaatattcatgtgctgattagccatagcccgagctgcctgaatcgtgatgatatgaatatgcagaaagatgccatttttggcggtaaacgtcgtgttcgtattagcagccagagcctgaaacgtgcaatgcgtaaaagcggttattatgcacagaatattggtgaaagcagcctgcgtaccattcatctggcacagctgcgtgatgttctgcgtcagaaactgggtgaacgttttgatcagaaaattattgataaaaccctggcactgctgagtggcaaaagcgttgatgaagcagaaaaaattagcgcagatgcagttaccccgtgggttgttggtgaaattgcctggttttgcgaacaggttgccaaagccgaagcagataatctggatgataaaaaactgctgaaagttctgaaagaagatattgccgccattcgtgttaatctgcagcagggtgttgatattgcactgagcggtcgtatggcaaccagcggtatgatgaccgaactgggtaaagttgatggtgcaatgagcattgcacatgcaattaccacccatcaggttgatagcgatattgattggtttaccgcagttgatgatctgcaggaacagggtagcgcacatctgggtacacaggaatttagcagcggtgtgttttatcgttatgcaaatattaatctggcccagctgcaggaaaatctgggtggtgcaagccgtgaacaggcactggaaattgcaacccatgttgttcatatgctggcaaccgaagttccgggtgcaaaacagcgtacctatgcagcctttaatccggcagatatggttatggttaattttagcgatatgccgctgtcaatggcaaatgcctttgaaaaagcagtgaaagccaaagatggttttctgcagccgagcattcaggcatttaatcagtattgggatcgtgttgcaaatggctatggtctgaatggtgcagcagcacagtttagcctgagcgatgttgatccgattaccgcacaggttaaacagatgccgaccctggaacagctgaaaagctgggttcgtaataatggtgaagcataataaggaatgtccgatttgtctggaactgggcgcctagcataaccccttggggcctctaaacgggtcttgaggggttttttgataatagcccggaacatctgaaagatgaagtgtctattattcagtcaatgggttatcgcaatcgtgcaaaacgcctgctgcagagcgaaccggaaaatcctaatacgactcactataggcccctcaagaaataattttgtttaactttaagctttaagaaggagatatagatatgcgtagctatctgattctgcgtctggcaggtccgatgcaggcatggggtcagccgacatttgaaggtacacgtccgacaggtcgttttccgacacgtagtggtctgctgggtctgctgggtgcatgtctgggtattcagcgtgatgataccagcagtctgcaggcactgagcgaaagcgtgcagtttgcagttcgttgtgatgaactgattctggatgatcgtcgtgttagcgtgaccggtctgcgtgattatcataccgttctgggtgcacgtgaagattatcgtggtctgaaaagccatgaaaccattcagacctggcgtgaatatctgtgtgatgcaagttttaccgttgcactgtggctgaccccgcatgcaacaatggttattagcgaactggaaaaagcagttctgaaaccgcgttataccccgtatctgggtcgtcgtagctgtccgctgacccatccgctgtttctgggtacatgtcaggcaagcgatccgcagaaagcactgctgaattatgaaccggttggtggtgatatttatagcgaagaaagcgttaccggtcatcatctgaaatttaccgcacgtgatgaaccgatgattaccctgccgcgtcagtttgcaagccgtgaatggtatgttattaaaggtggtatggatgttagccagtaataagaaccggttagcaccaagtgtgatcggtacccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgaatctgctgattgataattggattccggttcgtccgcgtaatggtggtaaagttcagattattaatctgcagagcctgtattgtagccgtgatcagtggcgtctgagcctgccgcgtgatgatatggaactggcagcactggcactgctggtttgtattggtcagattattgcaccggcaaaagatgatgttgaatttcgccatcgtattatgaatccgctgaccgaagatgaatttcagcagctgattgccccgtggattgatatgttttatctgaatcatgcagaacatccgtttatgcagaccaaaggtgttaaagcaaatgatgttaccccgatggaaaaactgctggccggtgttagcggtgcaaccaattgtgcatttgttaatcagccgggtcagggtgaagcactgtgtggtggttgtaccgcaattgcactgtttaatcaggcgaatcaggccccgggttttggtggtggttttaaaagcggtctgcgtggtggtacaccggttaccacctttgttcgtggtattgatctgcgtagcaccgttctgctgaatgttctgaccctgccgcgtctgcagaaacagtttccgaatgaaagccataccgaaaatcagccgacctggattaaaccgattaaaagcaatgaaagcattccggcaagcagcattggttttgtgcgtggtctgttttggcagccggcacatattgaactgtgtgatccgattggtattggtaaatgtagctgttgtggtcaggaaagcaatctgcgttataccggctttctgaaagagaaatttacctttaccgttaatggtctgtggccgcatccgcatagcccgtgtctggttaccgtgaaaaaaggtgaagttgaagaaaaatttctggcatttaccaccagcgcaccgagctggacccagattagccgtgttgttgttgataaaattattcagaatgaaaatggcaatcgtgttgcagcagttgtgaatcagtttcgtaatattgcgccgcagagcccgctggaactaattatgggtggttatcgtaataatcaggcaagcattctggaacgccgtcatgatgttctgatgtttaatcagggttggcagcagtatggtaatgtgattaatgaaattgtgaccgttggtctgggctataaaaccgcactgcgtaaagcgctgtatacctttgccgaaggctttaaaaacaaagattttaaaggtgcaggcgttagcgttcatgaaaccgccgaacgtcatttttatcgtcagagcgaactgctgattccggatgtgctggcaaatgttaattttagccaggcagatgaagttattgcagatctgcgcgataaactgcatcagctgtgtgaaatgctgtttaatcagagcgttgcaccgtatgcacatcatccgaaactgattagcaccctggccctggcacgtgcaaccctgtataaacatctgcgtgaactgaaaccgcagggtggtccgagcaatggttaataaggatctgtcagcactgcgtgttgaaggatcccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtatctgagcaaagttattattgcacgtgcatggagccgtgatctgtatcagctgcatcagggtctgtggcatctgtttccgaatcgtccggatgcagcccgtgattttctgtttcatgttgaaaaacgtaataccccggaaggttgtcatgttctgctgcagagcgcacagatgccggttagcaccgcagttgcaaccgttattaaaaccaaacaggtggaatttcagctgcaggttggtgttccgctgtattttcgtctgcgtgccaatccgattaaaaccattctggataatcagaaacgtctggatagcaaaggtaatattaaacgttgccgcgtgccgctgattaaagaagccgaacagattgcatggctgcagcgtaaactgggtaatgcagcacgtgttgaagatgttcatccgattagcgaacgtccgcagtattttagcggtgatggtaaaagcggtaaaattcagaccgtttgttttgaaggtgttctgaccattaatgatgcaccggcactgattgatctggttcagcagggtattggtccggcaaaaagcatgggttgtggtctgctgagtctggccccgctgtaataagtccgagtcagtgtcctctgtgtaaccatgggatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 366 - DNA, 10210 bp, Artificial Sequence
  Synthetic: Polypromoter(EcoCO), CRISPR(J3/L3)_Cse2_Cas7_Cas5_Cas8_FokI-30aa-Cas6
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggcagatgaaattgatgcaatggcactgtatcgtgcatggcagcagctggataatggtagctgtgcacagattcgtcgtgttagcgaaccggatgaactgcgtgatattccggcattttatcgtctggttcagccgtttggttgggaaaatccgcgtcatcagcaggcactgctgcgtatggttttttgtctgagcgcaggtaaaaatgttattcgtcatcaggataaaaaaagcgaacagaccaccggtattagcctgggtcgtgcactggcaaatagcggtcgtattaatgaacgtcgtatttttcagctgattcgtgcagatcgtaccgcagatatggttcagctgcgtcgtctgctgacccatgcagaaccggttctggattggccgctgatggcacgtatgctgacctggtggggtaaacgtgaacgtcagcagctgctggaagattttgttctgaccaccaataaaaatgcctaataagcagaatgttatcaatgccatgcaggaattctagcataaccccttggggcctctaaacgggtcttgaggggttttttggttttagccagctggttgaagaactgctgaaaattatttgtgcatttcagctggataccggtctggaatatgcaaatagctacaattttgccaaaaaagataatacgactcactataggcccctgtagaaataattttgtttaactttaataaggagatataccatgagcaactttattaatattcatgtgctgattagccatagcccgagctgcctgaatcgtgatgatatgaatatgcagaaagatgccatttttggcggtaaacgtcgtgttcgtattagcagccagagcctgaaacgtgcaatgcgtaaaagcggttattatgcacagaatattggtgaaagcagcctgcgtaccattcatctggcacagctgcgtgatgttctgcgtcagaaactgggtgaacgttttgatcagaaaattattgataaaaccctggcactgctgagtggcaaaagcgttgatgaagcagaaaaaattagcgcagatgcagttaccccgtgggttgttggtgaaattgcctggttttgcgaacaggttgccaaagccgaagcagataatctggatgataaaaaactgctgaaagttctgaaagaagatattgccgccattcgtgttaatctgcagcagggtgttgatattgcactgagcggtcgtatggcaaccagcggtatgatgaccgaactgggtaaagttgatggtgcaatgagcattgcacatgcaattaccacccatcaggttgatagcgatattgattggtttaccgcagttgatgatctgcaggaacagggtagcgcacatctgggtacacaggaatttagcagcggtgtgttttatcgttatgcaaatattaatctggcccagctgcaggaaaatctgggtggtgcaagccgtgaacaggcactggaaattgcaacccatgttgttcatatgctggcaaccgaagttccgggtgcaaaacagcgtacctatgcagcctttaatccggcagatatggttatggttaattttagcgatatgccgctgtcaatggcaaatgcctttgaaaaagcagtgaaagccaaagatggttttctgcagccgagcattcaggcatttaatcagtattgggatcgtgttgcaaatggctatggtctgaatggtgcagcagcacagtttagcctgagcgatgttgatccgattaccgcacaggttaaacagatgccgaccctggaacagctgaaaagctgggttcgtaataatggtgaagcataataaggaatgtccgatttgtctggaactgggcgcctagcataaccccttggggcctctaaacgggtcttgaggggttttttgataatagcccggaacatctgaaagatgaagtgtctattattcagtcaatgggttatcgcaatcgtgcaaaacgcctgctgcagagcgaaccggaaaatcctaatacgactcactataggcccctcaagaaataattttgtttaactttaagctttaagaaggagatatagatatgcgtagctatctgattctgcgtctggcaggtccgatgcaggcatggggtcagccgacatttgaaggtacacgtccgacaggtcgttttccgacacgtagtggtctgctgggtctgctgggtgcatgtctgggtattcagcgtgatgataccagcagtctgcaggcactgagcgaaagcgtgcagtttgcagttcgttgtgatgaactgattctggatgatcgtcgtgttagcgtgaccggtctgcgtgattatcataccgttctgggtgcacgtgaagattatcgtggtctgaaaagccatgaaaccattcagacctggcgtgaatatctgtgtgatgcaagttttaccgttgcactgtggctgaccccgcatgcaacaatggttattagcgaactggaaaaagcagttctgaaaccgcgttataccccgtatctgggtcgtcgtagctgtccgctgacccatccgctgtttctgggtacatgtcaggcaagcgatccgcagaaagcactgctgaattatgaaccggttggtggtgatatttatagcgaagaaagcgttaccggtcatcatctgaaatttaccgcacgtgatgaaccgatgattaccctgccgcgtcagtttgcaagccgtgaatggtatgttattaaaggtggtatggatgttagccagtaataagaaccggttagcaccaagtgtgatcggtacccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgaatctgctgattgataattggattccggttcgtccgcgtaatggtggtaaagttcagattattaatctgcagagcctgtattgtagccgtgatcagtggcgtctgagcctgccgcgtgatgatatggaactggcagcactggcactgctggtttgtattggtcagattattgcaccggcaaaagatgatgttgaatttcgccatcgtattatgaatccgctgaccgaagatgaatttcagcagctgattgccccgtggattgatatgttttatctgaatcatgcagaacatccgtttatgcagaccaaaggtgttaaagcaaatgatgttaccccgatggaaaaactgctggccggtgttagcggtgcaaccaattgtgcatttgttaatcagccgggtcagggtgaagcactgtgtggtggttgtaccgcaattgcactgtttaatcaggcgaatcaggccccgggttttggtggtggttttaaaagcggtctgcgtggtggtacaccggttaccacctttgttcgtggtattgatctgcgtagcaccgttctgctgaatgttctgaccctgccgcgtctgcagaaacagtttccgaatgaaagccataccgaaaatcagccgacctggattaaaccgattaaaagcaatgaaagcattccggcaagcagcattggttttgtgcgtggtctgttttggcagccggcacatattgaactgtgtgatccgattggtattggtaaatgtagctgttgtggtcaggaaagcaatctgcgttataccggctttctgaaagagaaatttacctttaccgttaatggtctgtggccgcatccgcatagcccgtgtctggttaccgtgaaaaaaggtgaagttgaagaaaaatttctggcatttaccaccagcgcaccgagctggacccagattagccgtgttgttgttgataaaattattcagaatgaaaatggcaatcgtgttgcagcagttgtgaatcagtttcgtaatattgcgccgcagagcccgctggaactaattatgggtggttatcgtaataatcaggcaagcattctggaacgccgtcatgatgttctgatgtttaatcagggttggcagcagtatggtaatgtgattaatgaaattgtgaccgttggtctgggctataaaaccgcactgcgtaaagcgctgtatacctttgccgaaggctttaaaaacaaagattttaaaggtgcaggcgttagcgttcatgaaaccgccgaacgtcatttttatcgtcagagcgaactgctgattccggatgtgctggcaaatgttaattttagccaggcagatgaagttattgcagatctgcgcgataaactgcatcagctgtgtgaaatgctgtttaatcagagcgttgcaccgtatgcacatcatccgaaactgattagcaccctggccctggcacgtgcaaccctgtataaacatctgcgtgaactgaaaccgcagggtggtccgagcaatggttaataaggatctgtcagcactgcgtgttgaaggatcccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgccgaaaaaaaagcgcaaagtgggtggctctcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgtatctgagcaaagttattattgcacgtgcatggagccgtgatctgtatcagctgcatcagggtctgtggcatctgtttccgaatcgtccggatgcagcccgtgattttctgtttcatgttgaaaaacgtaataccccggaaggttgtcatgttctgctgcagagcgcacagatgccggttagcaccgcagttgcaaccgttattaaaaccaaacaggtggaatttcagctgcaggttggtgttccgctgtattttcgtctgcgtgccaatccgattaaaaccattctggataatcagaaacgtctggatagcaaaggtaatattaaacgttgccgcgtgccgctgattaaagaagccgaacagattgcatggctgcagcgtaaactgggtaatgcagcacgtgttgaagatgttcatccgattagcgaacgtccgcagtattttagcggtgatggtaaaagcggtaaaattcagaccgtttgttttgaaggtgttctgaccattaatgatgcaccggcactgattgatctggttcagcagggtattggtccggcaaaaagcatgggttgtggtctgctgagtctggccccgctgtaataagtccgagtcagtgtcctctgtgtaaccatgggatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 367 - DNA, 10201 bp, Artificial Sequence
  Synthetic: Polypromoter(EcoCO), CRISPR(J3/L3)_Cse2_Cas7_Cas5_Cas6_FokI-30aa-Cas8
ggcaccatgcatcgatcccgcgaaatgcggccgcttaattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagagctagcgagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccggagctcgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatggcagatgaaattgatgcaatggcactgtatcgtgcatggcagcagctggataatggtagctgtgcacagattcgtcgtgttagcgaaccggatgaactgcgtgatattccggcattttatcgtctggttcagccgtttggttgggaaaatccgcgtcatcagcaggcactgctgcgtatggttttttgtctgagcgcaggtaaaaatgttattcgtcatcaggataaaaaaagcgaacagaccaccggtattagcctgggtcgtgcactggcaaatagcggtcgtattaatgaacgtcgtatttttcagctgattcgtgcagatcgtaccgcagatatggttcagctgcgtcgtctgctgacccatgcagaaccggttctggattggccgctgatggcacgtatgctgacctggtggggtaaacgtgaacgtcagcagctgctggaagattttgttctgaccaccaataaaaatgcctaataagcagaatgttatcaatgccatgcaggaattctagcataaccccttggggcctctaaacgggtcttgaggggttttttggttttagccagctggttgaagaactgctgaaaattatttgtgcatttcagctggataccggtctggaatatgcaaatagctacaattttgccaaaaaagataatacgactcactataggcccctgtagaaataattttgtttaactttaataaggagatataccatgagcaactttattaatattcatgtgctgattagccatagcccgagctgcctgaatcgtgatgatatgaatatgcagaaagatgccatttttggcggtaaacgtcgtgttcgtattagcagccagagcctgaaacgtgcaatgcgtaaaagcggttattatgcacagaatattggtgaaagcagcctgcgtaccattcatctggcacagctgcgtgatgttctgcgtcagaaactgggtgaacgttttgatcagaaaattattgataaaaccctggcactgctgagtggcaaaagcgttgatgaagcagaaaaaattagcgcagatgcagttaccccgtgggttgttggtgaaattgcctggttttgcgaacaggttgccaaagccgaagcagataatctggatgataaaaaactgctgaaagttctgaaagaagatattgccgccattcgtgttaatctgcagcagggtgttgatattgcactgagcggtcgtatggcaaccagcggtatgatgaccgaactgggtaaagttgatggtgcaatgagcattgcacatgcaattaccacccatcaggttgatagcgatattgattggtttaccgcagttgatgatctgcaggaacagggtagcgcacatctgggtacacaggaatttagcagcggtgtgttttatcgttatgcaaatattaatctggcccagctgcaggaaaatctgggtggtgcaagccgtgaacaggcactggaaattgcaacccatgttgttcatatgctggcaaccgaagttccgggtgcaaaacagcgtacctatgcagcctttaatccggcagatatggttatggttaattttagcgatatgccgctgtcaatggcaaatgcctttgaaaaagcagtgaaagccaaagatggttttctgcagccgagcattcaggcatttaatcagtattgggatcgtgttgcaaatggctatggtctgaatggtgcagcagcacagtttagcctgagcgatgttgatccgattaccgcacaggttaaacagatgccgaccctggaacagctgaaaagctgggttcgtaataatggtgaagcataataaggaatgtccgatttgtctggaactgggcgcctagcataaccccttggggcctctaaacgggtcttgaggggttttttgataatagcccggaacatctgaaagatgaagtgtctattattcagtcaatgggttatcgcaatcgtgcaaaacgcctgctgcagagcgaaccggaaaatcctaatacgactcactataggcccctcaagaaataattttgtttaactttaagctttaagaaggagatatagatatgcgtagctatctgattctgcgtctggcaggtccgatgcaggcatggggtcagccgacatttgaaggtacacgtccgacaggtcgttttccgacacgtagtggtctgctgggtctgctgggtgcatgtctgggtattcagcgtgatgataccagcagtctgcaggcactgagcgaaagcgtgcagtttgcagttcgttgtgatgaactgattctggatgatcgtcgtgttagcgtgaccggtctgcgtgattatcataccgttctgggtgcacgtgaagattatcgtggtctgaaaagccatgaaaccattcagacctggcgtgaatatctgtgtgatgcaagttttaccgttgcactgtggctgaccccgcatgcaacaatggttattagcgaactggaaaaagcagttctgaaaccgcgttataccccgtatctgggtcgtcgtagctgtccgctgacccatccgctgtttctgggtacatgtcaggcaagcgatccgcagaaagcactgctgaattatgaaccggttggtggtgatatttatagcgaagaaagcgttaccggtcatcatctgaaatttaccgcacgtgatgaaccgatgattaccctgccgcgtcagtttgcaagccgtgaatggtatgttattaaaggtggtatggatgttagccagtaataagaaccggttagcaccaagtgtgatcggtacccatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgtatctgagcaaagttattattgcacgtgcatggagccgtgatctgtatcagctgcatcagggtctgtggcatctgtttccgaatcgtccggatgcagcccgtgattttctgtttcatgttgaaaaacgtaataccccggaaggttgtcatgttctgctgcagagcgcacagatgccggttagcaccgcagttgcaaccgttattaaaaccaaacaggtggaatttcagctgcaggttggtgttccgctgtattttcgtctgcgtgccaatccgattaaaaccattctggataatcagaaacgtctggatagcaaaggtaatattaaacgttgccgcgtgccgctgattaaagaagccgaacagattgcatggctgcagcgtaaactgggtaatgcagcacgtgttgaagatgttcatccgattagcgaacgtccgcagtattttagcggtgatggtaaaagcggtaaaattcagaccgtttgttttgaaggtgttctgaccattaatgatgcaccggcactgattgatctggttcagcagggtattggtccggcaaaaagcatgggttgtggtctgctgagtctggccccgctgtaataagtccgagtcagtgtcctctgtgtaaccatgggatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgattaaggcatcaaataaaacgaaaggctcagtcgaaagactgggcctttcgttttatctgttgtttgtcggtgagtccttccagtctgggcgaaagcgcggtcgatcaaattaagcagaaggccatcctgacggatggcctttttgcgtttctatcgatcccgcgaaattaatacgactcactataggcccctctagaaataattttgtttaactttaagctttaagaaggagatatagatcatgccgaaaaaaaagcgcaaagtgcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctaataaggatctgtcagcactgcgtgttgaaggatccgatcccaactccataagtggctgctgccaccgctgagcatagcataaccccttggggcctctaaacgggtcttgaggggttttttgctgaaaggaggaactatatcaagtcccgaagtagctgtcagactgctggcgaccgccgcaactagtggcgtcatgcgtgccgtatggtctttcgcctgtagacgccctacaagccgtactaaagtggaaagacccgcaaaaggtatcgcgatcgccctgcagggaactatatccgactagtagcccgcctaatgagcgggcttttttttaattcccctatttgtttatttttctaaatacattcaaatatgtatccgctcatgagacaataaccctgataaatgcttcgaaaaaggaagagtatgagtattcaacatttccgtgtcgcccttattcccttttttgcggcattttgccttcctgtttttgctcacccagaaacgctcgtgaaagtaaaagacgcagaggaccaattgggggcacgagtgggatacatagaactggacttgaatagcggtaaaatccttgagagttttcgccctgaagagcgttttccaatgatgagcactttcaaagttctgctatgtggagcagtattatcccgtgtagatgcggggcaagagcaactcggacgacgaatacactattcgcagaatgacttggttgaatactccccagtgacagaaaagcaccttacggacggaatgacggtaagagaattatgtagtgccgccataacgatgagtgataacactgcggcgaacttacttctgacaaccatcggtggaccgaaggaattaaccgcttttttgcacaatatgggagaccatgtaactcgccttgaccgttgggaaccagaactgaatgaagccataccaaacgacgagcgagacaccacaatgcctgcggcaatggcaacaacattacgcaaactattaactggcgaactacttactctggcttcacggcaacaattaatagactggcttgaagcggataaagttgcaggaccactactgcgttcggcacttcctgctggctggtttattgctgataaatctggggcaggagagcgtggttcacggggtatcattgccgcacttggaccagatggtaagccttcccgtatcgtagttatctacacgacgggtagtcaggcaactatggacgaacgaaatagacagattgctgaaataggggcttcactgattaagcattggtaaaccgatacaattaaaggctccttttggagcctttttttttggacggaccggtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgtt

SEQ ID NO: 368 - DNA, 6926 bp, Artificial Sequence
  Synthetic: Cas8, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 369 - DNA, 6925 bp, Artificial Sequence
  Synthetic: NLSCas8, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 370 - DNA, 7630 bp, Artificial Sequence
  Synthetic: NLSHAFokI30aaCas8, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggctcaggctatccctatgacgtacccgactacgcgcaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 371 - DNA, 5933 bp, Artificial Sequence
  Synthetic: NLSCse2, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgccgaaaaaaaagcggaaggtcggatcaggaatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgcctaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 372 - DNA, 6542 bp, Artificial Sequence
  Synthetic: NLS-Cas7, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgccgaaaaaaaagcggaaggtcggatcaggaatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 373 - DNA, 6092 bp, Artificial Sequence
  Synthetic: Cas5, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagtaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 374 - DNA, 6091 bp, Artificial Sequence
  Synthetic: NLSCas5, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 375 - DNA, 6017 bp, Artificial Sequence
  Synthetic: Cas6, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 376 - DNA, 6016 bp, Artificial Sequence
  Synthetic: NLSCas6, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 377 - DNA, 6736 bp, Artificial Sequence
  Synthetic: NLSV5FokI30aaCas8, HsCO
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggctcaggcggtaaacccatcccaaaccccttgcttggtctcgactcaacccaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 378 - DNA, 8114 bp, Artificial Sequence
  Synthetic: Cas3NLS, HsCO
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatggagccttttaaatatatttgtcattactggggtaagagttccaagagcctgacaaaaggcaatgatatacatcttttgatctatcactgtctcgacgtcgcagcggtagcggattgctggtgggatcaaagtgtcgtgctccagaacacgttttgtcgaaacgaaatgctcagcaagcagcgggtaaaagcatggctccttttctttattgctctccacgacataggcaaattcgacattaggttccagtacaaatctgcagagagttggttgaaattgaacccggccacccctagcctgaacggcccttcaactcagatgtgcaggaaatttaaccatggagccgctgggttgtattggtttaatcaggacagtttgtcagagcaaagtctgggggatttcttctccttttttgacgccgcgcctcatccttacgagagctggtttccatgggtcgaggccgtcacagggcaccatggctttattcttcactctcaggaccaagacaaatctcgatgggaaatgcctgccagtctggcgtcttacgccgcgcaggataagcaagcacgagaagaatggatttccgtcttggaggcgctgtttctcacacccgccgggctctctatcaacgacataccccccgattgctctagtctgcttgccggtttttgctcccttgccgattggcttggttcatggacgaccaccaatacgtttttgttcaatgaagatgcaccatctgatataaatgcattgaggacgtattttcaagacagacagcaagatgcctccagagttttggagctttctggacttgtatcaaataagagatgctacgaaggagtgcatgctctgctggacaacggctaccagccacgacaacttcaagttctcgttgatgccctcccggtggctccggggttgaccgtcatagaggcgcctactggatcagggaagaccgagacagccttggcctatgcgtggaaactgatagatcaacagattgccgactcagtgatcttcgcgctgccaactcaggcaacagccaacgcgatgctgacacgcatggaggccagcgcaagtcaccttttctctagtccaaatctgatactggcccatggtaattctaggtttaaccatctgtttcagtccatcaagtctagggcgataactgagcaaggacaggaagaagcctgggttcaatgctgccagtggcttagccagagtaacaagaaagtattcttgggacagattggtgtctgcacaatagaccaagtactcatctcagttttgcctgttaagcaccgattcatacgaggacttggaatcgggcgcagtgtcctcatagtagatgaggtgcatgcttacgacacctacatgaacggtttgctcgaggcggtgctcaaagcacaagctgatgtcggaggtagcgtgatccttctcagcgctacgcttcctatgaaacagaagcagaagttgctcgatacctatggtctgcatacggatcctgtggaaaataatagtgcctaccccctcataaactggaggggagtaaatggtgcacagaggtttgaccttcttgctcaccctgagcagcttcctccccggttttccatacagccggagccgatttgtcttgccgacatgcttccagatctcacaatgctcgaacggatgatcgcggccgctaatgccggcgcacaagtctgtctcatctgtaaccttgtcgatgtagcgcaggtttgttaccaacgactcaaagaactgaataatacacaagtagacatagatctgttccatgctcgctttacactcaatgacagaagggaaaaagaaaatcgggtcatctcaaattttggtaagaacggaaaacgaaacgttggccgaatcctcgtcgcaacccaggtagtggagcagtccctcgatgtggactttgactggcttattacacagcactgccctgctgacctcctgttccagcgacttggcagattgcatagacatcaccggaaatatcggcctgcaggttttgagataccagtcgcaactattcttctccccgacggggaagggtacgggcgacacgagcacatctatagcaacgtacgggtaatgtggcggacgcaacaacacatcgaggaacttaacggagcatccctgtttttccccgatgcctatagacaatggctcgacagtatttatgatgacgccgaaatggacgaacccgagtgggtcggaaatggtatggataaatttgaatccgcagaatgtgaaaaacggttcaaagcacggaaggtcctccagtgggctgaggagtattcattgcaggataacgacgaaaccatcttggctgtcactagagacggcgaaatgtcccttccactgcttccttatgttcaaacctcttctgggaaacagcttcttgatggccaggtatatgaggacctgtcccacgaacaacagtacgaggcacttgccttgaaccgcgttaatgtacctttcacttggaaacgatcattttcagaggtcgtagatgaagatgggctcctttggctggaaggcaaacaaaacctggatggatgggtatggcagggaaactctattgtaataacatacactggcgatgagggtatgacgagggttataccggcgaatccgaaatccgggtcacccaaaaagaagagaaaagtataataacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 379 - DNA, 4804 bp, Artificial Sequence
  Synthetic: CRISPR(Hsa07)
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggcctcaccgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccgtttttttcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 380 - DNA, 8701 bp, Artificial Sequence
  Synthetic: Polycistronic(HsCO), NLSCas7_NLSCse2_NLSCas5_NLSCas6
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 381 - DNA, 10300 bp, Artificial Sequence
  Synthetic: Polycistronic(HsCO), NLSCas7_NLSCse2_NLSCas5_NLSCas6_NLSCas8
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 382 - DNA, 10978 bp, Artificial Sequence
  Synthetic: Polycistronic(HsCO), NLSCas7_NLSCse2_NLSCas5_NLSCas6_NLSFokI30aaCas8
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 383 - DNA, 10813 bp, Artificial Sequence
  Synthetic: Polycistronic(HsCO), NLSCas7_NLSCse2_NLSCas5_NLSCas6_NLSFokI30aaCas8, no epitope tags
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaatcctggacctcccaaaaaaaaacggaaggtgggctcaggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 384 - DNA, 10813 bp, Artificial Sequence
  Synthetic: Polycistronic(HsCO), NLSCas7_NLSCse2_NLSCas5_NLSFokI30aaCas6_NLSCas8, no epitope tags
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaatcctggacctcccaaaaaaaaacggaaggtgggctcaggccaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 385 - DNA, 6475 bp, Artificial Sequence
  Synthetic: eGFP_MALAT1-triplex_CRISPR(Hsa07)
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgggctccgggattggtagtgggagcaacggcagcagcggatccgtgagcaagggcgaggagctgttcaccggggtggtgcccatcctggtcgagctggacggcgacgtaaacggccacaagttcagcgtgcgcggcgagggcgagggcgatgccaccaacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatctccttcaaggacgacggcacctacaagacccgcgccgaggtgaagttcgagggcgacaccctggtgaaccgcatcgagctgaagggcatcgacttcaaggaggacggcaacatcctggggcacaagctggagtacaacttcaacagccacaacgtctatatcacggccgacaagcagaagaacggcatcaaggcgaacttcaagatccgccacaacgtcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaagtagtaatctagagattcgtcagtagggttgtaaaggtttttcttttcctgagaaaacaaccttttgttttctcaggttttgctttttggcctttccctagctttaaaaaaaaaaaagcaaaactcaccgaggcagttataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 386 - DNA, 6854 bp, Artificial Sequence
  Synthetic: NLSCas7_MALAT1-triplex_CRISPR(Hsa07)
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccaccatgccgaaaaaaaagcggaaggtcggatcaggaatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaataacattggaagtggataatctagagattcgtcagtagggttgtaaaggtttttcttttcctgagaaaacaaccttttgttttctcaggttttgctttttggcctttccctagctttaaaaaaaaaaaagcaaaactcaccgaggcagttataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 387 - DNA, 6328 bp, Artificial Sequence
  Synthetic: NLSCas6_MALAT1-triplex_CRISPR(Hsa07)
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagattcgtcagtagggttgtaaaggtttttcttttcctgagaaaacaaccttttgttttctcaggttttgctttttggcctttccctagctttaaaaaaaaaaaagcaaaactcaccgaggcagttataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 388 - DNA, 11541 bp, Artificial Sequence
  Synthetic: hU6_CRISPR(Hsa07)_F, CMV_NLSCas7_NLSCse2_NLSCas5_NLSCas6_NLSFokI30aaCas8
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggatcctaatacgactcactatagggtaaggagatataccatgggctagcgagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccggagctcgctgagcaataactctgaaacctcaggcatttgagaagtctagatttttttcggaaagaaccagctggggctctagggggtatccccacgcgccctgtagcacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 389 - DNA, 11541 bp, Artificial Sequence
  Synthetic: hU6_CRISPR(Hsa07)_R, CMV_NLSCas7_NLSCse2_NLSCas5_NLSCas6_NLSFokI30aaCas8
ctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgtgctacagggcgcgtggggataccccctagagccccagctggttctttccgaaaaaaatctagacttctcaaatgcctgaggtttcagagttattgctcagcgagctccggtttatccccgctggcgcggggaactcctgaaggcctaggcaaagaagaacacaacttacggtttatccccgctggcgcggggaactcagactgtgtaacaccaatgcaggcaaatcaaccggtttatccccgctggcgcggggaactcgctagcccatggtatatctccttaccctatagtgagtcgtattaggatccggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattccaattatctctctaacagccttgtatcgtatatgcaaatatgaaggaatcatgggaaataggccctcacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaaccccggcccccccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaacccagggccacccaagaaaaagagaaaagtaggctcaggcggtaaacccatcccaaaccccttgcttggtctcgactcaaccggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggt

SEQ ID NO: 390 - DNA, 555 bp, Artificial Sequence
  Synthetic: StrepIIHRV3C-Cse2
atggcaagctggagccacccgcagttcgaaaagggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaa

SEQ ID NO: 391 - protein, 184 aa, Artificial Sequence
  Synthetic: StrepIIHRV3C-Cse2
MASWSHPQFEKGALEVLFQGPGYQMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 392 - DNA, 549 bp, Artificial Sequence
  Synthetic: His6HRV3CCse2
atggctgagcatcaccaccatcatcacggtgcacttgaagtcctctttcagggacccgggtaccagatggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaa

SEQ ID NO: 393 - protein, 182 aa, Artificial Sequence
  Synthetic: His6HRV3CCse2
MAEHHHHHHGALEVLFQGPGYQMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 394 - DNA, 516 bp, Artificial Sequence
  Synthetic: NLSCse2
atgccgaaaaaaaagcggaaggtcggatcaggaatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgcctaa

SEQ ID NO: 395 - protein, 171 aa, Artificial Sequence
  Synthetic: NLSCse2
MPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 396 - DNA, 708 bp, Artificial Sequence
  Synthetic: NLSCas5
atgcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagtaa

SEQ ID NO: 397 - protein, 235 aa, Artificial Sequence
  Synthetic: NLSCas5
MPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQ

SEQ ID NO: 398 - DNA, 633 bp, Artificial Sequence
  Synthetic: NLS-Cas6
atgccaaagaaaaaacgtaaggttggcggtagcatgtacctcagcaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtga

SEQ ID NO: 399 - protein, 210 aa, Artificial Sequence
  Synthetic: NLS-Cas6
MPKKKRKVGGSMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 400 - DNA, 669 bp, Artificial Sequence
  Synthetic: NLS-HA-Cas6
atgccaaagaaaaaacgtaaggttggcggtagctatccgtacgatgttccagactacgccggcggctccatgtacctcagcaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtga

SEQ ID NO: 401 - protein, 222 aa, Artificial Sequence
  Synthetic: NLS-HA-Cas6
MPKKKRKVGGSYPYDVPDYAGGSMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 402 - DNA, 633 bp, Artificial Sequence
  Synthetic: NLS-Cas6
atgcccaagaaaaagagaaaagtaggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaa

SEQ ID NO: 403 - protein, 210 aa, Artificial Sequence
  Synthetic: NLS-Cas6
MPKKKRKVGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 404 - DNA, 1122 bp, Artificial Sequence
  Synthetic: Cas7-NLS
atgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgggcggtagcccaaagaaaaaacgtaaggtttga

SEQ ID NO: 405 - protein, 373 aa, Artificial Sequence
  Synthetic: Cas7-NLS
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGGSPKKKRKV

SEQ ID NO: 406 - DNA, 1158 bp, Artificial Sequence
  Synthetic: Cas7-HA-NLS
atgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgggcggctcctatccgtacgatgttccagactacgccggcggtagcccaaagaaaaaacgtaaggtttga

SEQ ID NO: 407 - protein, 385 aa, Artificial Sequence
  Synthetic: Cas7-HA-NLS
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGGSYPYDVPDYAGGSPKKKRKV

SEQ ID NO: 408 - DNA, 1125 bp, Artificial Sequence
  Synthetic: NLS-Cas7
atgccgaaaaaaaagcggaaggtcggatcaggaatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaa

SEQ ID NO: 409 - protein, 374 aa, Artificial Sequence
  Synthetic: NLS-Cas7
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 410 - DNA, 2670 bp, Artificial Sequence
  Synthetic: His6-MBP-TEV-Cas8
atgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatgcaatgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctga

SEQ ID NO: 411 - protein, 889 aa, Artificial Sequence
  Synthetic: His6-MBP-TEV-Cas8
MHHHHHHGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNGIEENLYFQSNAMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 412 - DNA, 3369 bp, Artificial Sequence
  Synthetic: His6-MBP-TEV-NLS-FokI-linker-Cas8
atgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatatgccgaaaaaaaagcgcaaagtgcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctga

SEQ ID NO: 413 - protein, 1122 aa, Artificial Sequence
  Synthetic: His6-MBP-TEV-NLS-FokI-linker-Cas8
MHHHHHHGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNGIEENLYFQSNMPKKKRKVQLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFSGSETPGTSESATPESGGSGSSGGSGSSGGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 414 - DNA, 1542 bp, Artificial Sequence
  Synthetic: NLS-Cas8
atgcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaa

SEQ ID NO: 415 - protein, 513 aa, Artificial Sequence
  Synthetic: NLS-Cas8
MPKKKRKVGSGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 416 - DNA, 2247 bp, Artificial Sequence
  Synthetic: NLS-HA-FokI-linker-Cas8
atgcccaagaaaaagagaaaagtaggctcaggctatccctatgacgtacccgactacgcgcaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcagcggctccgaaacgccgggtacatccgagtccgcgactcctgagtcaggaggcagcggctcctctggtggaagcggctcaagtggagggatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaa

SEQ ID NO: 417 - protein, 748 aa, Artificial Sequence
  Synthetic: NLS-HA-FokI-linker-Cas8
MPKKKRKVGSGYPYDVPDYAQLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFSGSETPGTSESATPESGGSGSSGGSGSSGGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 418 - protein, 6 aa, Artificial Sequence
  Synthetic: hexahistidine
HHHHHH

SEQ ID NO: 419 - protein, 8 aa, Artificial Sequence
  Synthetic: Strep-tag
WSHPQFEK

SEQ ID NO: 420 - protein, 8 aa, Artificial Sequence
  Synthetic: HRV3C (human rhinovirus 3C) protease recognition sequence
LEVLFQGP

SEQ ID NO: 421 - protein, 7 aa, Artificial Sequence
  Synthetic: nuclear localization signal
PKKKRKV

SEQ ID NO: 422 - protein, 9 aa, Artificial Sequence
  Synthetic: hemagglutinin
YPYDVPDYA

SEQ ID NO: 423 - protein, 367 aa, Artificial Sequence
  Synthetic: maltose binding protein
KIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTN

SEQ ID NO: 424 - protein, 7 aa, Artificial Sequence
  Synthetic: TEV (tobacco etch virus) protease recognition sequence
ENLYFQS

SEQ ID NO: 425 - protein, 30 aa, Artificial Sequence
  Synthetic: linker polypeptide
SGSETPGTSESATPESGGSGSSGGSGSSGG

SEQ ID NO: 426 - protein, 5 aa, Artificial Sequence
  Synthetic: 5-amino acid linker, FokI-Cas8 fusion
GGGGS

SEQ ID NO: 427 - protein, 8 aa, Artificial Sequence
  Synthetic: 8-amino acid linker, FokI-Cas8 fusion
TGPGAAAR

SEQ ID NO: 428 - protein, 10 aa, Artificial Sequence
  Synthetic: 10-amino acid linker, FokI-Cas8 fusion
GGSGSSGGSG

SEQ ID NO: 429 - protein, 12 aa, Artificial Sequence
  Synthetic: 12-amino acid linker, FokI-Cas8 fusion
TGPGAAARAASG

SEQ ID NO: 430 - protein, 15 aa, Artificial Sequence
  Synthetic: 15-amino acid linker, FokI-Cas8 fusion
GGSGSSGGSGSSGGS

SEQ ID NO: 431 - protein, 16 aa, Artificial Sequence
  Synthetic: 16-amino acid linker, FokI-Cas8 fusion
SGSETPGTSESATPES

SEQ ID NO: 432 - protein, 20 aa, Artificial Sequence
  Synthetic: 20-amino acid linker, FokI-Cas8 fusion
SGSETPGTSESATPESGGSG

SEQ ID NO: 433 - protein, 30 aa, Artificial Sequence; identical to SEQ ID NO: 425
  Synthetic: 30-amino acid linker, FokI-Cas8 fusion

SEQ ID NO: 434 - DNA, 90 bp, Artificial Sequence
  Synthetic: CRISPR(J3)
gagttccccgcgccagcggggataaaccgccagtgataagtggaatgccatgtgggctgtcgagttccccgcgccagcggggataaaccg

SEQ ID NO: 435 - DNA, 90 bp, Artificial Sequence
  Synthetic: CRISPR(L3)
gagttccccgcgccagcggggataaaccgagtggcagatatagcctggtggttcaggcggcgagttccccgcgccagcggggataaaccg

SEQ ID NO: 436 - DNA, 151 bp, Artificial Sequence
  Synthetic: CRISPR(J3/L3)
gagttccccgcgccagcggggataaaccgccagtgataagtggaatgccatgtgggctgtcgagttccccgcgccagcggggataaaccgagtggcagatatagcctggtggttcaggcggcgagttccccgcgccagcggggataaaccg

SEQ ID NO: 437 - DNA, 151 bp, Artificial Sequence
  Synthetic: CRISPR(TRAC)
gagttccccgcgccagcggggataaaccggttgatttgcctgcattggtgttacacagtctgagttccccgcgccagcggggataaaccgtaagttgtgttcttctttgcctaggccttcaggagttccccgcgccagcggggataaaccg

SEQ ID NO: 438 - DNA, 7967 bp, Artificial Sequence; identical to SEQ ID NO: 356
  Synthetic: His6-MBP-TEV-Cas8

SEQ ID NO: 439 - DNA, 8659 bp, Artificial Sequence
  Synthetic: His6-MBP-TEV-NLS-Fok1-linker-Cas8
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaactagtaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatgttttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaactaaggaggtccgctatgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatatgccgaaaaaaaagcgcaaagtgcaactggttaaaagcgaactggaagagaaaaaaagtgaactgcgccacaaactgaaatatgtgccgcatgaatatatcgagctgattgaaattgcacgtaatccgacccaggatcgtattctggaaatgaaagtgatggaattttttatgaaagtgtacggctatcgcggtgaacatctgggtggtagccgtaaaccggatggtgcaatttataccgttggtagcccgattgattatggtgttattgttgataccaaagcctatagcggtggttataatctgccgattggtcaggcagatgaaatgcagcgttatgtggaagaaaatcagacccgtaacaaacatattaatccgaatgaatggtggaaagtttatccgagcagcgttaccgagtttaaattcctgtttgttagcggtcacttcaaaggcaactataaagcacagctgacccgtctgaatcatattaccaattgtaatggtgcagttctgagcgttgaagaactgctgattggtggtgaaatgattaaagcaggcaccctgaccctggaagaagttcgtcgcaaatttaacaatggcgaaatcaacttttcaggcagcgaaacgccgggtacaagtgagtcagcaactccagagagcggcggcagtggtagtagtgggggatctgggtcatctggtgggatgaatttgcttattgataactggattcctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctgaattggaagtggataacggatccgaattcgagcgccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 440 - DNA, 6435 bp, Artificial Sequence; identical to SEQ ID NO: 357
  Synthetic: StrepII-HRV3C-Cse2_Cas7_Cas5_Cas6

SEQ ID NO: 441 - DNA, 7933 bp, Artificial Sequence; identical to SEQ ID NO: 358
  Synthetic: Cas8_His6HRV3CCse2_Cas7_Cas5_Cas6

SEQ ID NO: 442 - DNA, 8644 bp, Artificial Sequence; identical to SEQ ID NO: 359
  Synthetic: NLS-FokI-linker-Cas8_His6HRV3CCse2_Cas7_Cas5_Cas6

SEQ ID NO: 443 - DNA, 8687 bp, Artificial Sequence; identical to SEQ ID NO: 361
  Synthetic: NLS-FokI-linker-Cas8_His6HRV3CCse2_Cas7-NLS_Cas5_Cas6

SEQ ID NO: 444 - DNA, 3736 bp, Artificial Sequence; identical to SEQ ID NO: 352
  Synthetic: CRISPR(J3)

SEQ ID NO: 445 - DNA, 3736 bp, Artificial Sequence
  Synthetic: CRISPR(L3)
taatacgactcactataggggaattgtgagcggataacaattcccctgtagaaataattttgtttaactttaataaggagatataccatgggctagcgagttccccgcgccagcggggataaaccgagtggcagatatagcctggtggttcaggcggcgagttccccgcgccagcggggataaaccggagctcgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 446 - DNA, 3797 bp, Artificial Sequence; identical to SEQ ID NO: 354
  Synthetic: CRISPR(J3/L3)

SEQ ID NO: 447 - DNA, 3797 bp, Artificial Sequence; identical to SEQ ID NO: 355
  Synthetic: CRISPR(TRAC)

SEQ ID NO: 448 - DNA, 5974 bp, Artificial Sequence
  Synthetic: Cse2
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgattacaaagatcacgatggggactacaaggatcacgatattgactataaggacgacgatgacaagggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgcctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 449 - DNA, 6091 bp, Artificial Sequence; identical to SEQ ID NO: 374
  Synthetic: Cas5

SEQ ID NO: 450 - DNA, 6052 bp, Artificial Sequence
  Synthetic: Cas6
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggctcaggctatccctatgacgtacccgactacgcgggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 451 - DNA, 6547 bp, Artificial Sequence
  Synthetic: Cas7
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcccaagaaaaagagaaaagtaggatcgggcgaacagaaacttatatctgaggaggacctcggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagcctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 452 - DNA, 6925 bp, Artificial Sequence; identical to SEQ ID NO: 369
  Synthetic: Cas8

SEQ ID NO: 453 - DNA, 7630 bp, Artificial Sequence; identical to SEQ ID NO: 370
  Synthetic: FokI-Cas8

SEQ ID NO: 454 - DNA, 4804 bp, Artificial Sequence; identical to SEQ ID NO: 379
  Synthetic: CRISPR(TRAC)

SEQ ID NO: 455 - DNA, 10813 bp, Artificial Sequence; identical to SEQ ID NO: 383
  Synthetic: NLS-Cas7_NLS-Cse2_NLS-Cas5_NLS-Cas6_NLS-FokI-Cas8

SEQ ID NO: 456 - DNA, 11541 bp, Artificial Sequence; identical to SEQ ID NO: 388
  Synthetic: hU6_CRISPR(TRAC), CMV_NLSCas7_NLSCse2_NLSCas5_NLSCas6_NLSFokICas8

SEQ ID NO: 457 - DNA, 2667 bp, Artificial Sequence
  Synthetic: Cas3
atggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataa

SEQ ID NO: 458 - protein, 888 aa, Artificial Sequence; identical to SEQ ID NO: 21
  Synthetic: Cas3

SEQ ID NO: 459 - DNA, 3828 bp, Artificial Sequence
  Synthetic: His6-MBP-TEV-Cas3
atgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatgcaatggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataa

SEQ ID NO: 460 - protein, 1275 aa, Artificial Sequence
  Synthetic: His6-MBP-TEV-Cas3
MHHHHHHGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNGIEENLYFQSNAMEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 461 - DNA, 9125 bp, Artificial Sequence
  Synthetic: His6-MBP-TEV-Cas3
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaactagtaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatgttttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaactaaggaggtccgctatgcaccatcaccatcaccatggaaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaatgggatcgaggaaaacctgtacttccaatccaatgcaatggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataataataacattggaagtggataacggatccgaattcgagcgccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 462 - DNA, 2667 bp, Artificial Sequence
  Synthetic: Cas3, human codon optimized
atggagccttttaaatatatttgtcattactggggtaagagttccaagagcctgacaaaaggcaatgatatacatcttttgatctatcactgtctcgacgtcgcagcggtagcggattgctggtgggatcaaagtgtcgtgctccagaacacgttttgtcgaaacgaaatgctcagcaagcagcgggtaaaagcatggctccttttctttattgctctccacgacataggcaaattcgacattaggttccagtacaaatctgcagagagttggttgaaattgaacccggccacccctagcctgaacggcccttcaactcagatgtgcaggaaatttaaccatggagccgctgggttgtattggtttaatcaggacagtttgtcagagcaaagtctgggggatttcttctccttttttgacgccgcgcctcatccttacgagagctggtttccatgggtcgaggccgtcacagggcaccatggctttattcttcactctcaggaccaagacaaatctcgatgggaaatgcctgccagtctggcgtcttacgccgcgcaggataagcaagcacgagaagaatggatttccgtcttggaggcgctgtttctcacacccgccgggctctctatcaacgacataccccccgattgctctagtctgcttgccggtttttgctcccttgccgattggcttggttcatggacgaccaccaatacgtttttgttcaatgaagatgcaccatctgatataaatgcattgaggacgtattttcaagacagacagcaagatgcctccagagttttggagctttctggacttgtatcaaataagagatgctacgaaggagtgcatgctctgctggacaacggctaccagccacgacaacttcaagttctcgttgatgccctcccggtggctccggggttgaccgtcatagaggcgcctactggatcagggaagaccgagacagccttggcctatgcgtggaaactgatagatcaacagattgccgactcagtgatcttcgcgctgccaactcaggcaacagccaacgcgatgctgacacgcatggaggccagcgcaagtcaccttttctctagtccaaatctgatactggcccatggtaattctaggtttaaccatctgtttcagtccatcaagtctagggcgataactgagcaaggacaggaagaagcctgggttcaatgctgccagtggcttagccagagtaacaagaaagtattcttgggacagattggtgtctgcacaatagaccaagtactcatctcagttttgcctgttaagcaccgattcatacgaggacttggaatcgggcgcagtgtcctcatagtagatgaggtgcatgcttacgacacctacatgaacggtttgctcgaggcggtgctcaaagcacaagctgatgtcggaggtagcgtgatccttctcagcgctacgcttcctatgaaacagaagcagaagttgctcgatacctatggtctgcatacggatcctgtggaaaataatagtgcctaccccctcataaactggaggggagtaaatggtgcacagaggtttgaccttcttgctcaccctgagcagcttcctccccggttttccatacagccggagccgatttgtcttgccgacatgcttccagatctcacaatgctcgaacggatgatcgcggccgctaatgccggcgcacaagtctgtctcatctgtaaccttgtcgatgtagcgcaggtttgttaccaacgactcaaagaactgaataatacacaagtagacatagatctgttccatgctcgctttacactcaatgacagaagggaaaaagaaaatcgggtcatctcaaattttggtaagaacggaaaacgaaacgttggccgaatcctcgtcgcaacccaggtagtggagcagtccctcgatgtggactttgactggcttattacacagcactgccctgctgacctcctgttccagcgacttggcagattgcatagacatcaccggaaatatcggcctgcaggttttgagataccagtcgcaactattcttctccccgacggggaagggtacgggcgacacgagcacatctatagcaacgtacgggtaatgtggcggacgcaacaacacatcgaggaacttaacggagcatccctgtttttccccgatgcctatagacaatggctcgacagtatttatgatgacgccgaaatggacgaacccgagtgggtcggaaatggtatggataaatttgaatccgcagaatgtgaaaaacggttcaaagcacggaaggtcctccagtgggctgaggagtattcattgcaggataacgacgaaaccatcttggctgtcactagagacggcgaaatgtcccttccactgcttccttatgttcaaacctcttctgggaaacagcttcttgatggccaggtatatgaggacctgtcccacgaacaacagtacgaggcacttgccttgaaccgcgttaatgtacctttcacttggaaacgatcattttcagaggtcgtagatgaagatgggctcctttggctggaaggcaaacaaaacctggatggatgggtatggcagggaaactctattgtaataacatacactggcgatgagggtatgacgagggttataccggcgaatccgaaataa

SEQ ID NO: 463 - DNA, 2697 bp, Artificial Sequence
  Synthetic: Cas3-NLS
atggagccttttaaatatatttgtcattactggggtaagagttccaagagcctgacaaaaggcaatgatatacatcttttgatctatcactgtctcgacgtcgcagcggtagcggattgctggtgggatcaaagtgtcgtgctccagaacacgttttgtcgaaacgaaatgctcagcaagcagcgggtaaaagcatggctccttttctttattgctctccacgacataggcaaattcgacattaggttccagtacaaatctgcagagagttggttgaaattgaacccggccacccctagcctgaacggcccttcaactcagatgtgcaggaaatttaaccatggagccgctgggttgtattggtttaatcaggacagtttgtcagagcaaagtctgggggatttcttctccttttttgacgccgcgcctcatccttacgagagctggtttccatgggtcgaggccgtcacagggcaccatggctttattcttcactctcaggaccaagacaaatctcgatgggaaatgcctgccagtctggcgtcttacgccgcgcaggataagcaagcacgagaagaatggatttccgtcttggaggcgctgtttctcacacccgccgggctctctatcaacgacataccccccgattgctctagtctgcttgccggtttttgctcccttgccgattggcttggttcatggacgaccaccaatacgtttttgttcaatgaagatgcaccatctgatataaatgcattgaggacgtattttcaagacagacagcaagatgcctccagagttttggagctttctggacttgtatcaaataagagatgctacgaaggagtgcatgctctgctggacaacggctaccagccacgacaacttcaagttctcgttgatgccctcccggtggctccggggttgaccgtcatagaggcgcctactggatcagggaagaccgagacagccttggcctatgcgtggaaactgatagatcaacagattgccgactcagtgatcttcgcgctgccaactcaggcaacagccaacgcgatgctgacacgcatggaggccagcgcaagtcaccttttctctagtccaaatctgatactggcccatggtaattctaggtttaaccatctgtttcagtccatcaagtctagggcgataactgagcaaggacaggaagaagcctgggttcaatgctgccagtggcttagccagagtaacaagaaagtattcttgggacagattggtgtctgcacaatagaccaagtactcatctcagttttgcctgttaagcaccgattcatacgaggacttggaatcgggcgcagtgtcctcatagtagatgaggtgcatgcttacgacacctacatgaacggtttgctcgaggcggtgctcaaagcacaagctgatgtcggaggtagcgtgatccttctcagcgctacgcttcctatgaaacagaagcagaagttgctcgatacctatggtctgcatacggatcctgtggaaaataatagtgcctaccccctcataaactggaggggagtaaatggtgcacagaggtttgaccttcttgctcaccctgagcagcttcctccccggttttccatacagccggagccgatttgtcttgccgacatgcttccagatctcacaatgctcgaacggatgatcgcggccgctaatgccggcgcacaagtctgtctcatctgtaaccttgtcgatgtagcgcaggtttgttaccaacgactcaaagaactgaataatacacaagtagacatagatctgttccatgctcgctttacactcaatgacagaagggaaaaagaaaatcgggtcatctcaaattttggtaagaacggaaaacgaaacgttggccgaatcctcgtcgcaacccaggtagtggagcagtccctcgatgtggactttgactggcttattacacagcactgccctgctgacctcctgttccagcgacttggcagattgcatagacatcaccggaaatatcggcctgcaggttttgagataccagtcgcaactattcttctccccgacggggaagggtacgggcgacacgagcacatctatagcaacgtacgggtaatgtggcggacgcaacaacacatcgaggaacttaacggagcatccctgtttttccccgatgcctatagacaatggctcgacagtatttatgatgacgccgaaatggacgaacccgagtgggtcggaaatggtatggataaatttgaatccgcagaatgtgaaaaacggttcaaagcacggaaggtcctccagtgggctgaggagtattcattgcaggataacgacgaaaccatcttggctgtcactagagacggcgaaatgtcccttccactgcttccttatgttcaaacctcttctgggaaacagcttcttgatggccaggtatatgaggacctgtcccacgaacaacagtacgaggcacttgccttgaaccgcgttaatgtacctttcacttggaaacgatcattttcagaggtcgtagatgaagatgggctcctttggctggaaggcaaacaaaacctggatggatgggtatggcagggaaactctattgtaataacatacactggcgatgagggtatgacgagggttataccggcgaatccgaaatccgggtcacccaaaaagaagagaaaagtataa

SEQ ID NO: 464 - protein, 898 aa, Artificial Sequence
  Synthetic: Cas3-NLS
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPKSGSPKKKRKV

SEQ ID NO: 465 - DNA, 8114 bp, Artificial Sequence; identical to SEQ ID NO: 378
  Synthetic: Cas3-NLS

SEQ ID NO: 466 - DNA, 75 bp, Artificial Sequence
  Synthetic: Forward oligo, J3 target sequence
atcatcctcctgacaattttgacagcccacatggcattccacttatcactggcatctttaaaagccaggacggtc

SEQ ID NO: 467 - DNA, 75 bp, Artificial Sequence
  Synthetic: Reverse oligo, J3 target sequence
gaccgtcctggcttttaaagatgccagtgataagtggaatgccatgtgggctgtcaaaattgtcaggaggatgat

SEQ ID NO: 468 - DNA, 75 bp, Artificial Sequence
  Synthetic: target strand J3
cgccgagctcgaattcttttgacagcccacatggcattccacttatcactggcatggatcctggctgtggtgatg

SEQ ID NO: 469 - DNA, 75 bp, Artificial Sequence
  Synthetic: non target strand J3
catcaccacagccaggatccatgccagtgataagtggaatgccatgtgggctgtcaaaagaattcgagctcggcg

SEQ ID NO: 470 - DNA, 75 bp, Artificial Sequence
  Synthetic: target strand CCR5 Site
cgccgagctcgaattctttttaggtacctggctgtcgtccatgctgtgtttgcatggatcctggctgtggtgatg

SEQ ID NO: 471 - DNA, 75 bp, Artificial Sequence
  Synthetic: non target strand CCR5
catcaccacagccaggatccatgcaaacacagcatggacgacagccaggtacctaaaaagaattcgagctcggcg

SEQ ID NO: 472 - DNA, 75 bp, Artificial Sequence; identical to SEQ ID NO: 468
  Synthetic: target strand J3

SEQ ID NO: 473 - DNA, 75 bp, Artificial Sequence; identical to SEQ ID NO: 469
  Synthetic: non target strand J3

SEQ ID NO: 474 - DNA, 75 bp, Artificial Sequence; identical to SEQ ID NO: 470
  Synthetic: target strand CCR5 Site

SEQ ID NO: 475 - DNA, 52 bp, Artificial Sequence
  Synthetic: Forward primer to amplify Hsa07 dual-target from human genomic DNA
cactctttccctacacgacgctcttccgatctttcctccctaacctccacct

SEQ ID NO: 476 - DNA, 48 bp, Artificial Sequence
  Synthetic: Reverse primer to amplify Hsa07 dual-target from human genomic DNA
ggagttcagacgtgtgctcttccgatcttaaagagcccaaccagatgc

SEQ ID NO: 477 - DNA, 45 bp, Artificial Sequence
  Synthetic: Forward oligo, J3 target sequence for cloning into pACYC-Duet1
gatccatgccagtgataagtggaatgccatgtgggctgtcaaaag

SEQ ID NO: 478 - DNA, 45 bp, Artificial Sequence
  Synthetic: Reverse oligo, J3 target sequence for cloning into pACYC-Duet1
aattcttttgacagcccacatggcattccacttatcactggcatg

SEQ ID NO: 479 - DNA, 100 bp, Artificial Sequence
  Synthetic: Forward oligo, J3-15bp-L3 target sequences for cloning into pACYC-Duet1
aattcttttgacagcccacatggcattccacttatcactggcatcctaggcctctcgagatgagtggcagatatagcctggtggttcaggcggcgcatgc

SEQ ID NO: 480 - DNA, 99 bp, Artificial Sequence
  Synthetic: Reverse oligo, J3-15bp-L3 target sequences for cloning into pACYC-Duet1
tcagcatgcgccgcctgaaccaccaggctatatctgccactcatctcgagaggcctaggatgccagtgataagtggaatgccatgtgggctgtcaaaag

SEQ ID NO: 481 - DNA, 4068 bp, Artificial Sequence
  Synthetic: Complete vector sequence, J3 target sequence in pACYC-Duet1
taatacgactcactataggggaattgtgagcggataacaattcccctgtagaaataattttgtttaactttaataaggagatataccatgggcagcagccatcaccatcatcaccacagccaggatccatgccagtgataagtggaatgccatgtgggctgtcaaaagaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgtcagcattgcatattgtcagacgactcctgcattaggaaat

SEQ ID NO: 482 - DNA, 3769 bp, Artificial Sequence
  Synthetic: Complete vector sequence, J3-15bp-L3 target sequences in pACYC-Duet1
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcatcctaggcctctcgagatgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 483 - DNA, 3784 bp, Artificial Sequence
  Synthetic: Complete vector sequence, J3-30bp-L3 target sequences in pACYC-Duet1
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcatcctagcccttccactctttcgaaactcgagatgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 484 - DNA, 5815 bp, Artificial Sequence
  Synthetic: Complete vector sequence, multi-target plasmid
taatacgactcactataggggaattgtgagcggataacaattcccctgtagaaataattttgtttaactttaataaggagatataccatgggcagcagccatcaccatcatcaccacagccaggatccgaattcgagctctctaggtacctggctgtcgtccatgctgtgtttgcatcctaggcctctcgagcctaggcctctcgagatgtgtgatcacttgggtggtggctgtgtttgcgtgcttgacagcccacatggcattccacttatcactggcatcctagcccttccactctttcgaaactcgagatgagtggcagatatagcctggtggttcaggcggcgcctgggcctgaaaggcctccagctctgcctgcccgcttactgcctcagcttccctgccccacaaagggcctgaggtgctgcctgggcatgtgtaaaggtgtccaggcaaagccactgaggtccgggtgacagtgcttcggcaggctgacagccaggtgactgaagtctgtgcggcaacctacatgatggggaatgagttgtgtgaattatggtggtgctacaaacaagctcatctttggaactggcactctgcttgctgtccagccaagtacgtaagtagtggcatgtgtcaggtggattctgtatacaattatgtgtctgccggtccaaatgccttcttctataggccatgtttttatttctcttccaaaagagactccagagccatccttgggaagagtgctgagatcactgtgggaattcaggaaacacacctcttgtctttggaaagggcacaagactttctgtgattgcaagtaagtgtttctagccatccttgattttgatcagccaaggcaggatcccaggagacagagcagtagccactttgagtgaatttcccaggaggtgctcctgccaaggcccataccttcaaggaaaattaaggcaaatagaaaagactgtgtaacaccaatgcaggcaaatcaacctttggggatgggactacgctcactgtgaagccaagtaagttgtgttcttctttgcctaggccttcagggacatcaccaggttgtagaagttgacaggcagtgccatgggggcaacagccaaaataggggggtaatgatgtaggggccaagcagtgcccagctgggggtcaatagtttctgtcacatcagctccactttcagtgaaagcatcacttgggattaatatggggatgcagcattatgatgtgggtcaaggaattaagttagggaatggcgaagccgaaatgatcttttcaagttaaattttatgccttttatttcttaaacaaatgtatgattacatcaaggcttcaaaaatactcacatggctatgttttagccccaacagagccagaatgtgaaaagcaatttcagccttattttattcccatcaattgagaaaccattatgaagaagagagtccatatttcaatttccaagagctgaggcaaggcaaggctgctgcagcctcccctggctgtgcacattccctcctgctccccagagactgcctccgccatcccacagatgatggatcttcagtgggttctcttgggctctaggtcccaaaaggccacactggtgtgcctggccacaggcttctaccccgaccacgtggagctgagctggtgggtgaatgggaaggaggtgcacagtggggtcagcacagacccgcagctgtgctccctcgctccttcctctgcattgcccctcttctccctctccaaacagagggaactctcctacccccaaggaggtgaaagctgctaccacctctgtgcccccccggcaatgccaacatatctgggatcaaagctatctatataaagtccttgattctgtgtgggttcaaacacatttcaaagcttcaggatcctgaaaggttttgctctacttcctgaagacctgaacaccgccctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 485 - DNA, 95 bp, Artificial Sequence
  Synthetic: Target Hsa01
gggcctgaaaggcctccagctctgcctgcccgcttactgcctcagcttccctgccccacaaagggcctgaggtgctgcctgggcatgtgtaaagg

SEQ ID NO: 486 - DNA, 95 bp, Artificial Sequence
  Synthetic: Target Hsa02
caggcaaagccactgaggtccgggtgacagtgcttcggcaggctgacagccaggtgactgaagtctgtgcggcaacctacatgatggggaatgag

SEQ ID NO: 487 - DNA, 100 bp, Artificial Sequence
  Synthetic: Target Hsa03
gtgaattatggtggtgctacaaacaagctcatctttggaactggcactctgcttgctgtccagccaagtacgtaagtagtggcatgtgtcaggtggattc

SEQ ID NO: 488 - DNA, 100 bp, Artificial Sequence
  Synthetic: Target Hsa04
tacaattatgtgtctgccggtccaaatgccttcttctataggccatgtttttatttctcttccaaaagagactccagagccatccttgggaagagtgctg

SEQ ID NO: 489 - DNA, 100 bp, Artificial Sequence
  Synthetic: Target Hsa05
cactgtgggaattcaggaaacacacctcttgtctttggaaagggcacaagactttctgtgattgcaagtaagtgtttctagccatccttgattttgatca

SEQ ID NO: 490 - DNA, 100 bp, Artificial Sequence
  Synthetic: Target Hsa06
aggcaggatcccaggagacagagcagtagccactttgagtgaatttcccaggaggtgctcctgccaaggcccataccttcaaggaaaattaaggcaaata

SEQ ID NO: 491 - DNA, 100 bp, Artificial Sequence
  Synthetic: Target Hsa07
agactgtgtaacaccaatgcaggcaaatcaacctttggggatgggactacgctcactgtgaagccaagtaagttgtgttcttctttgcctaggccttcag

SEQ ID NO: 492 - DNA, 100 bp, Artificial Sequence
  Synthetic: Target Hsa08
atcaccaggttgtagaagttgacaggcagtgccatgggggcaacagccaaaataggggggtaatgatgtaggggccaagcagtgcccagctgggggtcaa

SEQ ID NO: 493 - DNA, 100 bp, Artificial Sequence
  Synthetic: Target Hsa09
ttctgtcacatcagctccactttcagtgaaagcatcacttgggattaatatggggatgcagcattatgatgtgggtcaaggaattaagttagggaatggc

SEQ ID NO: 494 - DNA, 100 bp, Artificial Sequence
  Synthetic: Target Hsa10
ccgaaatgatcttttcaagttaaattttatgccttttatttcttaaacaaatgtatgattacatcaaggcttcaaaaatactcacatggctatgttttag

SEQ ID NO: 495 - DNA, 115 bp, Artificial Sequence
  Synthetic: Target Hsa11
tgctccctcgctccttcctctgcattgcccctcttctccctctccaaacagagggaactctcctacccccaaggaggtgaaagctgctaccacctctgtgcccccccggcaatgc

SEQ ID NO: 496 - DNA, 105 bp, Artificial Sequence
  Synthetic: Target Hsa12
aacagagccagaatgtgaaaagcaatttcagccttattttattcccatcaattgagaaaccattatgaagaagagagtccatatttcaatttccaagagctgagg

SEQ ID NO: 497 - DNA, 110 bp, Artificial Sequence
  Synthetic: Target Hsa13
gcaaggctgctgcagcctcccctggctgtgcacattccctcctgctccccagagactgcctccgccatcccacagatgatggatcttcagtgggttctcttgggctctag

SEQ ID NO: 498 - DNA, 110 bp, Artificial Sequence
  Synthetic: Target Hsa14
caaaaggccacactggtgtgcctggccacaggcttctaccccgaccacgtggagctgagctggtgggtgaatgggaaggaggtgcacagtggggtcagcacagacccgca

SEQ ID NO: 499 - DNA, 115 bp, Artificial Sequence; identical to SEQ ID NO: 495
  Synthetic: Target Hsa15

SEQ ID NO: 500 - DNA, 115 bp, Artificial Sequence
  Synthetic: Target Hsa16
atatctgggatcaaagctatctatataaagtccttgattctgtgtgggttcaaacacatttcaaagcttcaggatcctgaaaggttttgctctacttcctgaagacctgaacacc

SEQ ID NO: 501 - RNA, 21 nt, Artificial Sequence
  Synthetic: sgRNA-J3 spacer sequence
gugauaaguggaaugccaugu

SEQ ID NO: 502 - DNA, 4008 bp, Artificial Sequence
  Synthetic: Complete vector sequence, pACYC-Duet1 non-target plasmid
taatacgactcactataggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 503 - DNA, 3784 bp, Artificial Sequence
  Synthetic: Complete vector sequence, J3-30bp-L3 target plasmid, J3 PAM mutant
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcggcctagcccttccactctttcgaaactcgagatgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 504 - DNA, 3784 bp, Artificial Sequence
  Synthetic: Complete vector sequence, J3-30bp-L3 target plasmid, L3 PAM mutant
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcatcctagcccttccactctttcgaaactcgagccgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 505 - DNA, 3784 bp, Artificial Sequence
  Synthetic: Complete vector sequence, J3-30bp-L3 target plasmid, J3/L3 PAM mutants
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcggcctagcccttccactctttcgaaactcgagccgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 506 - DNA, 3784 bp, Artificial Sequence
  Synthetic: Complete vector sequence, J3-30bp-L3 target plasmid, J3 spacer mutant
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatgtgacccatcctagcccttccactctttcgaaactcgagatgagtggcagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 507 - DNA, 3784 bp, Artificial Sequence
  Synthetic: Complete vector sequence, J3-30bp-L3 target plasmid, L3 spacer mutants
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatcactggcatcctagcccttccactctttcgaaactcgagatgtcaccgagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 508 - DNA, 3784 bp, Artificial Sequence
  Synthetic: Complete vector sequence, J3-30bp-L3 target plasmid, J3/L3 spacer mutants
taatacgactcactataggggaattgtgagcggataacaattcccctgtagaaataattttgtttaactttaataaggagatataccatgggcagcagccatcaccatcatcaccacagccaggatccgaattcttttgacagcccacatggcattccacttatgtgacccatcctagcccttccactctttcgaaactcgagatgtcaccgagatatagcctggtggttcaggcggcgcatgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 509 - DNA, 4068 bp, Artificial Sequence; identical to SEQ ID NO: 481
  Synthetic: Complete vector sequence, J3-only target plasmid

SEQ ID NO: 510 - DNA, 4047 bp, Artificial Sequence
  Synthetic: Complete vector sequence, L3-only target plasmid
taatacgactcactataggggaattgtgagcggataacaattcccctgtagaaataattttgtttaactttaataaggagatataccatgggcagcagccatcaccatcatcaccacagccaggatccatgcgccgcctgaaccaccaggctatatctgccactcatgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 511 - RNA, 61 nt, Artificial Sequence
  Synthetic: crRNA sequence, target Hsa01-1
auaaaccgcgggcaggcagagcuggaggccuuucaggcccgaguuccccgcgccagcgggg

SEQ ID NO: 512 - RNA, 61 nt, Artificial Sequence
  Synthetic: crRNA sequence, target Hsa01-2
auaaaccgggccugaggugcugccugggcauguguaaagggaguuccccgcgccagcgggg

SEQ ID NO: 513 - RNA, 61 nt, Artificial Sequence
  Synthetic: crRNA sequence, target Hsa02-1
auaaaccgcacugucacccggaccucaguggcuuugccuggaguuccccgcgccagcgggg

SEQ ID NO: 514 - RNA, 61 nt, Artificial Sequence
  Synthetic: crRNA sequence, target Hsa02-2
auaaaccgucugugcggcaaccuacaugauggggaaugaggaguuccccgcgccagcgggg

SEQ ID NO: 515 - RNA, 61 nt, Artificial Sequence
  Synthetic: crRNA sequence, target Hsa03-1
auaaaccgaugagcuuguuuguagcaccaccauaauucacgaguuccccgcgccagcgggg

SEQ ID NO: 516 - RNA, 61 nt, Artificial Sequence
  Synthetic: crRNA sequence, target Hsa03-2
auaaaccguacguaaguaguggcaugugucagguggauucgaguuccccgcgccagcgggg

SEQ ID NO: 517 - RNA, 61 nt, Artificial Sequence
  Synthetic: crRNA sequence, target Hsa04-1
auaaaccgaaggcauuuggaccggcagacacauaauuguagaguuccccgcgccagcgggg

SEQ ID NO: 518 - RNA, 61 nt, Artificial Sequence
  Synthetic: crRNA sequence, target Hsa04-2
auaaaccgagacuccagagccauccuugggaagagugcuggaguuccccgcgccagcgggg

SEQ ID NO: 519 - RNA, 61 nt, Artificial Sequence
  Synthetic: crRNA sequence, target Hsa05-1
auaaaccgacaagagguguguuuccugaauucccacaguggaguuccccgcgccagcgggg

SEQ ID NO: 520 - RNA, 61 nt, Artificial Sequence
  Synthetic: crRNA sequence, target Hsa05-2
auaaaccguaaguguuucuagccauccuugauuuugaucagaguuccccgcgccagcgggg

SEQ ID NO: 521 - RNA, 61 nt, Artificial Sequence
  Synthetic: crRNA sequence, target Hsa06-1
auaaaccguggcuacugcucugucuccugggauccugccugaguuccccgcgccagcgggg

SEQ ID NO: 522 - RNA, 61 nt, Artificial Sequence
  Synthetic: crRNA sequence, target Hsa06-2
auaaaccggcccauaccuucaaggaaaauuaaggcaaauagaguuccccgcgccagcgggg

SEQ ID NO: 523 - RNA, 61 nt, Artificial Sequence
  Synthetic: crRNA sequence, target Hsa07-1
auaaaccgguugauuugccugcauugguguuacacagucugaguuccccgcgccagcgggg

SEQ ID NO: 524 - RNA, 61 nt, Artificial Sequence
  Synthetic: crRNA sequence, target Hsa07-2
auaaaccguaaguuguguucuucuuugccuaggccuucaggaguuccccgcgccagcgggg

SEQ ID NO: 525 - RNA, 61 nt, Artificial Sequence
  Synthetic: crRNA sequence, target Hsa08-1
auaaaccggcacugccugucaacuucuacaaccuggugaugaguuccccgcgccagcgggg

SEQ ID NO: 526 - RNA, 61 nt, Artificial Sequence
  Synthetic: crRNA sequence, target Hsa08-2
auaaaccguaggggccaagcagugcccagcugggggucaagaguuccccgcgccagcgggg

SEQ ID NO: 527 - RNA, 61 nt, Artificial Sequence
  Synthetic: crRNA sequence, target Hsa09-1
auaaaccgcuuucacugaaaguggagcugaugugacagaagaguuccccgcgccagcgggg

SEQ ID NO: 528 - RNA, 61 nt, Artificial Sequence
  Synthetic: crRNA sequence, target Hsa09-2
auaaaccgaugugggucaaggaauuaaguuagggaauggcgaguuccccgcgccagcgggg

SEQ ID NO: 529 - RNA, 61 nt, Artificial Sequence
  Synthetic: crRNA sequence, target Hsa10-1
auaaaccggcauaaaauuuaacuugaaaagaucauuucgggaguuccccgcgccagcgggg

SEQ ID NO: 530 - RNA, 61 nt, Artificial Sequence
  Synthetic: crRNA sequence, target Hsa10-2
auaaaccggcuucaaaaauacucacauggcuauguuuuaggaguuccccgcgccagcgggg

SEQ ID NO: 531 - RNA, 61 nt, Artificial Sequence
  Synthetic: crRNA sequence, target Hsa11-1
auaaaccgaggggcaaugcagaggaaggagcgagggagcagaguuccccgcgccagcgggg

SEQ ID NO: 532 - RNA, 61 nt, Artificial Sequence
  Synthetic: crRNA sequence, target Hsa11-2
auaaaccggaggugaaagcugcuaccaccucugugcccccgaguuccccgcgccagcgggg

SEQ ID NO: 533 - RNA, 61 nt, Artificial Sequence
  Synthetic: crRNA sequence, target Hsa12-1
auaaaccggcugaaauugcuuuucacauucuggcucuguugaguuccccgcgccagcgggg

SEQ ID NO: 534 - RNA, 61 nt, Artificial Sequence
  Synthetic: crRNA sequence, target Hsa12-2
auaaaccgagaguccauauuucaauuuccaagagcugagggaguuccccgcgccagcgggg

SEQ ID NO: 535 - RNA, 61 nt, Artificial Sequence
  Synthetic: crRNA sequence, target Hsa13-1
auaaaccgugcacagccaggggaggcugcagcagccuugcgaguuccccgcgccagcgggg

SEQ ID NO: 536 - RNA, 61 nt, Artificial Sequence
  Synthetic: crRNA sequence, target Hsa13-2
auaaaccgauggaucuucaguggguucucuugggcucuaggaguuccccgcgccagcgggg

SEQ ID NO: 537 - RNA, 61 nt, Artificial Sequence
  Synthetic: crRNA sequence, target Hsa14-1
auaaaccgccuguggccaggcacaccaguguggccuuuuggaguuccccgcgccagcgggg

SEQ ID NO: 538 - RNA, 61 nt, Artificial Sequence
  Synthetic: crRNA sequence, target Hsa14-2
auaaaccggaggugcacaguggggucagcacagacccgcagaguuccccgcgccagcgggg

SEQ ID NO: 539 - RNA, 61 nt, Artificial Sequence; identical to SEQ ID NO: 531
  Synthetic: crRNA sequence, target Hsa15-1

SEQ ID NO: 540 - RNA, 61 nt, Artificial Sequence
  Synthetic: crRNA sequence, target Hsa15-2
auaaaccgcugcuaccaccucugugcccccccggcaaugcgaguuccccgcgccagcgggg

SEQ ID NO: 541 - RNA, 61 nt, Artificial Sequence
  Synthetic: crRNA sequence, target Hsa16-1
auaaaccggacuuuauauagauagcuuugaucccagauaugaguuccccgcgccagcgggg

SEQ ID NO: 542 - RNA, 61 nt, Artificial Sequence
  Synthetic: crRNA sequence, target Hsa16-2
auaaaccgguuuugcucuacuuccugaagaccugaacaccgaguuccccgcgccagcgggg

SEQ ID NO: 543 - DNA, 97 bp, Artificial Sequence
  Synthetic: Oligo A
accgatgagcttgtttgtagcaccaccataattcacgagttccccgcgccagcggggataaaccgtacgtaagtagtggcatgtgtcaggtggattc

SEQ ID NO: 544 - DNA, 97 bp, Artificial Sequence
  Synthetic: Oligo B
actcgaatccacctgacacatgccactacttacgtacggtttatccccgctggcgcggggaactcgtgaattatggtggtgctacaaacaagctcat

SEQ ID NO: 545 - DNA, 97 bp, Artificial Sequence
  Synthetic: Oligo C
accgaaggcatttggaccggcagacacataattgtagagttccccgcgccagcggggataaaccgagactccagagccatccttgggaagagtgctg

SEQ ID NO: 546 - DNA, 97 bp, Artificial Sequence
  Synthetic: Oligo D
actccagcactcttcccaaggatggctctggagtctcggtttatccccgctggcgcggggaactctacaattatgtgtctgccggtccaaatgcctt

SEQ ID NO: 547 - DNA, 97 bp, Artificial Sequence
  Synthetic: Oligo E
accgacaagaggtgtgtttcctgaattcccacagtggagttccccgcgccagcggggataaaccgtaagtgtttctagccatccttgattttgatca

SEQ ID NO: 548 - DNA, 97 bp, Artificial Sequence
  Synthetic: Oligo F
actctgatcaaaatcaaggatggctagaaacacttacggtttatccccgctggcgcggggaactccactgtgggaattcaggaaacacacctcttgt

SEQ ID NO: 549 - DNA, 97 bp, Artificial Sequence
  Synthetic: Oligo G
accgtggctactgctctgtctcctgggatcctgcctgagttccccgcgccagcggggataaaccggcccataccttcaaggaaaattaaggcaaata

SEQ ID NO: 550 - DNA, 97 bp, Artificial Sequence
  Synthetic: Oligo H
actctatttgccttaattttccttgaaggtatgggccggtttatccccgctggcgcggggaactcaggcaggatcccaggagacagagcagtagcca

SEQ ID NO: 551 - DNA, 97 bp, Artificial Sequence
  Synthetic: Oligo I
accggttgatttgcctgcattggtgttacacagtctgagttccccgcgccagcggggataaaccgtaagttgtgttcttctttgcctaggccttcag

SEQ ID NO: 552 - DNA, 97 bp, Artificial Sequence
  Synthetic: Oligo J
actcctgaaggcctaggcaaagaagaacacaacttacggtttatccccgctggcgcggggaactcagactgtgtaacaccaatgcaggcaaatcaac

SEQ ID NO: 553 - DNA, 97 bp, Artificial Sequence
  Synthetic: Oligo K
accggcactgcctgtcaacttctacaacctggtgatgagttccccgcgccagcggggataaaccgtaggggccaagcagtgcccagctgggggtcaa

SEQ ID NO: 554 - DNA, 97 bp, Artificial Sequence
  Synthetic: Oligo L
actcttgacccccagctgggcactgcttggcccctacggtttatccccgctggcgcggggaactcatcaccaggttgtagaagttgacaggcagtgc

SEQ ID NO: 555 - DNA, 97 bp, Artificial Sequence
  Synthetic: Oligo M
accgctttcactgaaagtggagctgatgtgacagaagagttccccgcgccagcggggataaaccgatgtgggtcaaggaattaagttagggaatggc

SEQ ID NO: 556 - DNA, 97 bp, Artificial Sequence
  Synthetic: Oligo N
actcgccattccctaacttaattccttgacccacatcggtttatccccgctggcgcggggaactcttctgtcacatcagctccactttcagtgaaag

SEQ ID NO: 557 - DNA, 97 bp, Artificial Sequence
  Synthetic: Oligo O
accggcataaaatttaacttgaaaagatcatttcgggagttccccgcgccagcggggataaaccggcttcaaaaatactcacatggctatgttttag

SEQ ID NO: 558 - DNA, 97 bp, Artificial Sequence
  Synthetic: Oligo P
actcctaaaacatagccatgtgagtatttttgaagccggtttatccccgctggcgcggggaactcccgaaatgatcttttcaagttaaattttatgc

SEQ ID NO: 559 - DNA, 52 bp, Artificial Sequence
  Synthetic: Oligo Q
cactctttccctacacgacgctcttccgatctagcctggaaagacacaaagc

SEQ ID NO: 560 - DNA, 48 bp, Artificial Sequence
  Synthetic: Oligo R
ggagttcagacgtgtgctcttccgatctcagccatcctttccacctaa

SEQ ID NO: 561 - DNA, 52 bp, Artificial Sequence
  Synthetic: Oligo S
cactctttccctacacgacgctcttccgatctatgctgcaggctttatgctt

SEQ ID NO: 562 - DNA, 48 bp, Artificial Sequence
  Synthetic: Oligo T
ggagttcagacgtgtgctcttccgatctttaggcctgcctgacttctc

SEQ ID NO: 563 - DNA, 53 bp, Artificial Sequence
  Synthetic: Oligo U
cactctttccctacacgacgctcttccgatctgggaagaagaccaacaagagg

SEQ ID NO: 564 - DNA, 48 bp, Artificial Sequence
  Synthetic: Oligo V
ggagttcagacgtgtgctcttccgatctttcaagggaagaagccattg

SEQ ID NO: 565 - DNA, 52 bp, Artificial Sequence
  Synthetic: Oligo W
cactctttccctacacgacgctcttccgatctaaggcaggaattggatgaaa

SEQ ID NO: 566 - DNA, 48 bp, Artificial Sequence
  Synthetic: Oligo X
ggagttcagacgtgtgctcttccgatctaacctgagatgactgcccat

SEQ ID NO: 567 - DNA, 52 bp, Artificial Sequence; identical to SEQ ID NO: 475
  Synthetic: Oligo Y

SEQ ID NO: 568 - DNA, 48 bp, Artificial Sequence; identical to SEQ ID NO: 476
  Synthetic: Oligo Z

SEQ ID NO: 569 - DNA, 52 bp, Artificial Sequence
  Synthetic: Oligo A2
cactctttccctacacgacgctcttccgatctgtctcagccttagccctgtg

SEQ ID NO: 570 - DNA, 48 bp, Artificial Sequence
  Synthetic: Oligo B2
ggagttcagacgtgtgctcttccgatctcccactgcaagtacaagggt

SEQ ID NO: 571 - DNA, 51 bp, Artificial Sequence
  Synthetic: Oligo C2
cactctttccctacacgacgctcttccgatctggatgcggaacccaaatta

SEQ ID NO: 572 - DNA, 48 bp, Artificial Sequence
  Synthetic: Oligo D2
ggagttcagacgtgtgctcttccgatcttagtcttctccctcgctccc

SEQ ID NO: 573 - DNA, 52 bp, Artificial Sequence
  Synthetic: Oligo E2
cactctttccctacacgacgctcttccgatcttgcagcattatgatgtgggt

SEQ ID NO: 574 - DNA, 49 bp, Artificial Sequence
  Synthetic: Oligo F2
ggagttcagacgtgtgctcttccgatctcaacctttagcatcactggct

SEQ ID NO: 575 - DNA, 57 bp, Artificial Sequence
  Synthetic: Oligo G2
  misc_feature (25)..(32): n is a, c, g, or t
caagcagaagacggcatacgagatnnnnnnnngtgactggagttcagacgtgtgctc

SEQ ID NO: 576 - DNA, 58 bp, Artificial Sequence
  Synthetic: Oligo H2
  misc_feature (30)..(37): n is a, c, g, or t
aatgatacggcgaccaccgagatctacacnnnnnnnnacactctttccctacacgacg

SEQ ID NO: 577 - protein, 210 aa, Artificial Sequence; identical to SEQ ID NO: 399
  Synthetic: NSL-Cas6

SEQ ID NO: 578 - protein, 366 aa, Artificial Sequence
  Synthetic: cpCas7 V1
MKDGFLQPSIQAFNQYWDRVANGYGLNGAAAQFSLSDVDPITAQVKQMPTLEQLKSWVRNNGEAGSMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKA

SEQ ID NO: 579 - protein, 366 aa, Artificial Sequence
  Synthetic: cpCas7 V2
MDPITAQVKQMPTLEQLKSWVRNNGEAGSMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDV

SEQ ID NO: 580 - protein, 583 aa, Artificial Sequence
  Synthetic: Fok1
MFLSMVSKIRTFGWVQNPGKFENLKRVVQVFDRNSKVHNEVKNIKIPTLVKESKIQKELVAIMNQHDLIYTYKELVGTGTSIRSEAPCDAIIQATIADQGNKKGYIDNWSSDGFLRWAHALGFIEYINKSDSFVITDVGLAYSKSADGSAIEKEILIEAISSYPPAIRILTLLEDGQHLTKFDLGKNLGFSGESGFTSLPEGILLDTLANAMPKDKGEIRNNWEGSSDKYARMIGGWLDKLGLVKQGKKEFIIPTLGKPDNKEFISHAFKITGEGLKVLRRAKGSTKFTRVPKRVYWEMLATNLTDKEYVRTRRALILEILIKAGSLKIEQIQDNLKKLGFDEVIETIENDIKGLINTGIFIEIKGRFYQLKDHILQFVIPNRGVTKQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 581 - protein, 196 aa, Artificial Sequence
  Synthetic: Fok1 sharkey
QLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 582 - protein, 30 aa, Artificial Sequence; identical to SEQ ID NO: 425
  Synthetic: Linker

SEQ ID NO: 583 - protein, 6 aa, Artificial Sequence
  Synthetic: Hexahistidine tag
HHHHHH

SEQ ID NO: 584 - protein, 367 aa, Artificial Sequence; identical to SEQ ID NO: 423
  Synthetic: MBP

SEQ ID NO: 585 - protein, 7 aa, Artificial Sequence
  Synthetic: TEV
ENLYFQS

SEQ ID NO: 586 - protein, 7 aa, Artificial Sequence
  Synthetic: NLS
PKKKRKV

SEQ ID NO: 587 - protein, 738 aa, Artificial Sequence
  Synthetic: NLS-Fok1_Linker-Cas8
SNMPKKKRKVQLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFSGSETPGTSESATPESGGSGSSGGSGSSGGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 588 - protein, 330 aa, Artificial Sequence
  Synthetic: CasB-CasB
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 589 - protein, 10 aa, Artificial Sequence
  Synthetic: Linker
SGGSGGSGGS

SEQ ID NO: 590 - protein, 229 aa, Artificial Sequence [sequence omitted]

SEQ ID NO: 591 - protein, 9 aa, Artificial Sequence
  Synthetic: Linker
GGSGGSGGS

SEQ ID NO: 592 - protein, 568 aa, Artificial Sequence
  Synthetic: rAPOBEC1_CasB-CasB
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 593 - protein, 731 aa, Artificial Sequence
  Synthetic: Cas8_rAPOBEC1
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 594 - protein, 700 aa, Artificial Sequence
  Synthetic: Cas8_AID
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGL

SEQ ID NO: 595 - protein, 710 aa, Artificial Sequence
  Synthetic: Cas8_PmCDA1
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 596 - protein, 738 aa, Artificial Sequence
  Synthetic: Cas8_Human APOBEC1
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 597 - protein, 875 aa, Artificial Sequence
  Synthetic: Cas8_APOBEC3F
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 598 - protein, 886 aa, Artificial Sequence
  Synthetic: Cas8_APOBEC3G
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGMKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 599 - protein, 157 aa, Artificial Sequence
  Synthetic: PvuIIHIFIT46G
MSHPDLNKLLELWPHIQEYQDLALKHGINDIFQDNGGKLLQVLLIGGLTVLPGREGNDAVDNAGQEYELKSINIDLTKGFSTHHHMNPVIIAKYRQVPWIFAIYRGIAIEAIYRLEPKDLEFYYDKWERKWYSDGHKDINNPKIPVKYVMEHGTKIY

SEQ ID NO: 600 - protein, 316 aa, Artificial Sequence
  Synthetic: PvuIIsinglechainT46G
SHPDLNKLLELWPHIQEYQDLALKHGINDIFQDNGGKLLQVLLIGGLTVLPGREGNDAVDNAGQEYELKSINIDLTKGFSTHHHMNPVIIAKYRQVPWIFAIYRGIAIEAIYRLEPKDLEFYYDKWERKWYSDGHKDINNPKIPVKYVMEHGTKIYGSGGSHPDLNKLLELWPHIQEYQDLALKHGINDIFQDNGGKLLQVLLIGGLTVLPGREGNDAVDNAGQEYELKSINIDLTKGFSTHHHMNPVIIAKYRQVPWIFAIYRGIAIEAIYRLEPKDLEFYYDKWERKWYSDGHKDINNPKIPVKYVMEHGTKIY

SEQ ID NO: 601 - protein, 169 aa, Artificial Sequence
  Synthetic: I-TevI1-169Q158R
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIRTSAYTCSKCRN

SEQ ID NO: 602 - protein, 169 aa, Artificial Sequence
  Synthetic: I-TevI1-169
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRN

SEQ ID NO: 603 - protein, 238 aa, Artificial Sequence
  Synthetic: BcnI singlechain
MKIWSKEEVVNKLHEIKNKGYLSVPTDMFRTDDGVVGQILERQFGVQENNITLGDLGEFELKGMRNRKAKSNLTLFHKKPVAGQTVIQIFNRFGYVKPSSRNPEVMKKKLFTTIKGGRLNNLGLTLNAKHASEINLYYQDEYLSTWDLNLSKIEKLVLVFAETIGRANSPEEQFHFTKAYMLTEINDITSLINDGVLVMDLCIDQDLSKSKGPHDRGPHLRIPISKLDKLYRNIERLL

SEQ ID NO: 604 - protein, 249 aa, Artificial Sequence
  Synthetic: MvaI singlechain
MKSMSEYLNLLKEAIQNVVDGGWHETKRKGNTGIGKTFEDLLEKEEDNLDAPDFHDIEIKTHETAAKSLLTLFTKSPTNPRGANTMLRNRYGKKDEYGNNILHQTVSGNRKTNSNSYNYDFKIDIDWESQVVRLEVFDKQDIMIDNSVYWSFDSLQNQLDKKLKYIAVISAESKIENEKKYYKYNSANLFTDLTVQSLCRGIENGDIKVDIRIGAYHSGKKKGKTHDHGTAFRINMEKLLEYGEVKVIV

SEQ ID NO: 605 - protein, 260 aa, Artificial Sequence
  Synthetic: DNaseI
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 606 - protein, 888 aa, Artificial Sequence; identical to SEQ ID NO: 21
  Synthetic: Cas3

SEQ ID NO: 607 - protein, 267 aa, Artificial Sequence
  Synthetic: S1Aspergillus
WGNLGHETVAYIAQSFVASSTESFCQNILGDDSTSYLANVATWADTYKYTDAGEFSKPYHFIDAQDNPPQSCGVDYDRDCGSAGCSISAIQNYTNILLESPNGSEALNALKFVVHIIGDIHQPLHDENLEAGGNGIDVTYDGETTNLHHIWDTNMPEEAAGGYSLSVAKTYADLLTERIKTGTYSSKKDSWTDGIDIKDPVSTSMIWAADANTYVCSTVLDDGLAYINSTDLSGEYYDKSQPVFEELIAKAGYRLAAWLDLIASQPS

SEQ ID NO: 608 - protein, 568 aa, Artificial Sequence; identical to SEQ ID NO: 592
  Synthetic: rAPOBEC1

SEQ ID NO: 609 - protein, 537 aa, Artificial Sequence
  Synthetic: AID
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGGSGGSGGSMDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGL

SEQ ID NO: 610 - protein, 547 aa, Artificial Sequence
  Synthetic: CPmCDA1
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGGSGGSGGSMTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 611 - protein, 575 aa, Artificial Sequence
  Synthetic: Human APOBEC1
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWRGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 612 - protein, 712 aa, Artificial Sequence
  Synthetic: Human APOBEC3F
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILEGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 613 - protein, 723 aa, Artificial Sequence
  Synthetic: APOBEC3G
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQENGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNASGGSGGSGGSMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 614 - protein, 11 aa, Artificial Sequence
  Synthetic: VP16
DALDDFDLDML

SEQ ID NO: 615 - protein, 50 aa, Artificial Sequence
  Synthetic: VP64
DALDDFDLDMLGSDALDDFDLDMLGSDALDDFDLDMLGSDALDDFDLDML

SEQ ID NO: 616 - protein, 366 aa, Artificial Sequence; identical to SEQ ID NO: 579
  Synthetic: cpCas7 V2

SEQ ID NO: 617 - RNA, 92 nt, Artificial Sequence
  Synthetic: tracrRNA (RNA)
agcauagcaaguuaaaauaaggcuaguccguuaucaacuugaaaaaguggcaccgagucggugcuuaaguucacugccguauaggcagcuuu

SEQ ID NO: 618 - DNA, 92 bp, Artificial Sequence
  Synthetic: tracrRNA (DNA)
agcatagcaagttaaaataaggctagtccgttatcaacttgaaaaagtggcaccgagtcggtgcttaagttcactgccgtataggcagcttt

SEQ ID NO: 619 - RNA, 36 nt, Artificial Sequence
  Synthetic: CXCR4 targeting spacer (RNA)
gaaccagcgguuaccauggaguuuuagagcuaugcu

SEQ ID NO: 620 - DNA, 36 bp, Artificial Sequence
  Synthetic: CXCR4 targeting spacer (DNA)
gaaccagcggttaccatggagttttagagctatgct

SEQ ID NO: 621 - DNA, 918 bp, Escherichia coli K-12 MG1655
  misc_feature (1)..(918): Cas1
atgacctggcttccccttaatcccattccactcaaagatcgcgtctccatgatctttctgcaatatgggcagatcgatgtaatagatggcgcgtttgtacttatcgacaagacagggatccgcactcatattcctgttggctcggttgcctgcatcatgctggaacctggtacacgggtttcgcatgcagctgtacgcctggctgcgcaagttggaacattgttggtatgggtgggggaagcgggcgttcgtgtttatgcttctggtcagcctggaggtgcgcgttcagataagctgctctatcaggcaaaacttgctctggatgaagatttgcgtctgaaggtcgtacgtaaaatgtttgaacttcggtttggagaacctgcgcctgcccggcgctccgtagagcaactcagaggtatagaaggcagtcgcgtgcgggcaacctacgcacttctggcgaagcaatacggcgtgacatggaatggacgtcgctacgatccgaaagactgggaaaagggcgatacgatcaaccaatgcattagcgctgcaacttcctgtttatacggcgtaactgaagcggcgatacttgcagctggttatgcaccagctattgggtttgtgcatacaggaaagcctctttcctttgtttacgatattgcagacatcattaaatttgacactgttgtaccgaaagcttttgagatagcgcgtcgtaaccctggtgagccggaccgggaagtccgtttggcgtgcagggatatttttcgcagtagtaaaacattagccaaattgattccgcttatagaggacgtgcttgccgctggagaaatacaaccgccggccccacctgaagatgcacagcctgttgccattccgcttcctgtttcactgggagatgcaggccatcggagtagctga

SEQ ID NO: 622 - DNA, 1092 bp, Escherichia coli K-12 MG1655; identical to SEQ ID NO: 3
  misc_feature (1)..(1092): Cas7

SEQ ID NO: 623 - DNA, 675 bp, Escherichia coli K-12 MG1655; identical to SEQ ID NO: 9
  misc_feature (1)..(675): Cas5

SEQ ID NO: 624 - DNA, 2667 bp, Escherichia coli K-12 MG1655
  misc_feature (1)..(2667): Cas3
atggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatcttacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttatttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataa

SEQ ID NO: 625 - DNA, 97 bp, Artificial Sequence
  Synthetic: Hsa129F
accggcagcaggaagcgtggatgctggcctccctgtgagttccccgcgccagcggggataaaccgcaaagtcaaggagcatggaatcccggcccctc

SEQ ID NO: 626 - DNA, 97 bp, Artificial Sequence
  Synthetic: Hsa130F
accggtgcttgacatcattatgagctgagcattgctgagttccccgcgccagcggggataaaccggcttcctgtgtctaatgaccctgacaacccat

SEQ ID NO: 627 - DNA, 97 bp, Artificial Sequence
  Synthetic: Hsa131F
accggtaggccttgggtggccgatggcctcacagtggagttccccgcgccagcggggataaaccggagaagaagttcagttcagtgacaggtgagcc

SEQ ID NO: 628 - DNA, 97 bp, Artificial Sequence
  Synthetic: Hsa132F
accgacttgtctgtgttgcacagctaggtgaggcccgagttccccgcgccagcggggataaaccggcatcaccttaccatcagagcagtgcagtgct

SEQ ID NO: 629 - DNA, 97 bp, Artificial Sequence
  Synthetic: Hsa133F
accggagggctgagagagggacaagtcggaaccattgagttccccgcgccagcggggataaaccggggatgcttccgcctttccggggctgctggcc

SEQ ID NO: 630 - DNA, 97 bp, Artificial Sequence
  Synthetic: Hsa134F
accgagctgagcattgctgagctcggaaatcacctggagttccccgcgccagcggggataaaccggccagttttatgaatggcttcctgtgtctaat

SEQ ID NO: 631 - DNA, 97 bp, Artificial Sequence
  Synthetic: Hsa135F
accgtctacttccatagggaattgcaaccacagtatgagttccccgcgccagcggggataaaccggtcctgatcacttatgtaagtaactccattgt

SEQ ID NO: 632 - DNA, 97 bp, Artificial Sequence
  Synthetic: Hsa136F
accgtgacatgcccctggatgtcctcctccacacaggagttccccgcgccagcggggataaaccgcatgtacacccctaagatgcccatcgcgcagc

SEQ ID NO: 633 - DNA, 97 bp, Artificial Sequence
  Synthetic: Hsa137F
accggccatggaagacatgcaggatcttggtgaggtgagttccccgcgccagcggggataaaccgatgagtggcgacctgctggagctggtgagcca

SEQ ID NO: 634 - DNA, 97 bp, Artificial Sequence
  Synthetic: Hsa138F
accgaaggccatggaagacatgcaggatcttggtgagagttccccgcgccagcggggataaaccgagtggcgacctgctggagctggtgagccaccc

SEQ ID NO: 635 - DNA, 97 bp, Artificial Sequence
  Synthetic: Hsa139F
accgagggccatcagcacctttcacactcaccccccgagttccccgcgccagcggggataaaccgcccctgggggctccctgattaatggaggctta

SEQ ID NO: 636 - DNA, 97 bp, Artificial Sequence
  Synthetic: Hsa140F
accgctgaacagaaggtctcaggaagctccaggaaggagttccccgcgccagcggggataaaccgcatgcaagaaagatgactgtcccagcgagtgg

SEQ ID NO: 637 - DNA, 97 bp, Artificial Sequence
  Synthetic: Hsa141F
accgtggatcagtctctgcctcaactcggccagggtgagttccccgcgccagcggggataaaccgaggcctggttccctgaggaccagcgggtactg

SEQ ID NO: 638 - DNA, 97 bp, Artificial Sequence
  Synthetic: Hsa142F
accgcctggcacggaacaagagctcaataaaagtcagagttccccgcgccagcggggataaaccggaggcaggattcttcccatggataggggaggg

SEQ ID NO: 639 - DNA, 97 bp, Artificial Sequence
  Synthetic: Hsa143F
accgtgacatgcccctggatgtcctcctccacacaggagttccccgcgccagcggggataaaccgtacacccctaagatgcccatcgcgcagccctg

SEQ ID NO: 640 - DNA, 97 bp, Artificial Sequence
  Synthetic: Hsa144F
accgtttctctgagaattcagtgcatgcacatacaagagttccccgcgccagcggggataaaccggttcaaacaagctcaagagctagaagaaggag

SEQ ID NO: 641 - DNA, 97 bp, Artificial Sequence
  Synthetic: Hsa145F
accggagggctgagagagggacaagtcggaaccattgagttccccgcgccagcggggataaaccgcttccgcctttccggggctgctggcctggccc

SEQ ID NO: 642 - DNA, 97 bp, Artificial Sequence
  Synthetic: Hsa146F
accgtgtaccctgccgggtagtggagcgggttggctgagttccccgcgccagcggggataaaccgaaacctggaaccagagggggcgtgcctgccaa

SEQ ID NO: 643 - DNA, 97 bp, Artificial Sequence
  Synthetic: Hsa147F
accgattctgtatagcaacgcgtaccatctaagaccgagttccccgcgccagcggggataaaccgccaagtaagtgctgatttgttctcattcaact

SEQ ID NO: 644 - DNA, 97 bp, Artificial Sequence
  Synthetic: Hsa148F
accgctgaacagaaggtctcaggaagctccaggaaggagttccccgcgccagcggggataaaccgcaagaaagatgactgtcccagcgagtggcttc

SEQ ID NO: 645 - DNA, 97 bp, Artificial Sequence
  Synthetic: Hsa149F
accggaagacatgcaggatcttggtgaggtatccccgagttccccgcgccagcggggataaaccgatgagtggcgacctgctggagctggtgagcca

SEQ ID NO: 646 - DNA, 97 bp, Artificial Sequence
  Synthetic: Hsa150F
accggcagcaggaagcgtggatgctggcctccctgtgagttccccgcgccagcggggataaaccggagcatggaatcccggcccctcaggagcaggt

SEQ ID NO: 647 - DNA, 97 bp, Artificial Sequence
  Synthetic: Hsa151F
accgaactggactgtactgtcagcggagcccgagttgagttccccgcgccagcggggataaaccggagggagacggatttctttccttgctcagcaa

SEQ ID NO: 648 - DNA, 97 bp, Artificial Sequence
  Synthetic: Hsa152F
accggcaacttggcctcgactggaagtttctctgaggagttccccgcgccagcggggataaaccgaaggagctgctgtgtcagaggagccctcgtaa

SEQ ID NO: 649 - DNA, 97 bp, Artificial Sequence
  Synthetic: Hsa153F
accggctagcaccagctcctcgtagtcgccgtcctcgagttccccgcgccagcggggataaaccgcacccgagcacggaaccacagccaccttccac

SEQ ID NO: 650 - DNA, 97 bp, Artificial Sequence
  Synthetic: Hsa154F
accgctggcacccttggccacgccggcatcccggccgagttccccgcgccagcggggataaaccgggaagggcacggttagcggcaccctcataggt

SEQ ID NO: 651 - DNA, 97 bp, Artificial Sequence
  Synthetic: Hsa155F
accggggctgtcactggagctcctgggaggcctgcggagttccccgcgccagcggggataaaccgggctggggctgagctttaaaatggttccgact

SEQ ID NO: 652 - DNA, 97 bp, Artificial Sequence
  Synthetic: Hsa156F
accgggtggggggtaagctgaatggaatctctctcggagttccccgcgccagcggggataaaccgtgagaggggctgatggaagctgataggcagga

SEQ ID NO: 653 - DNA, 97 bp, Artificial Sequence
  Synthetic: Hsa157F
accgacatgcaggatcttggtgaggtatccccggcggagttccccgcgccagcggggataaaccgatgagtggcgacctgctggagctggtgagcca

SEQ ID NO: 654 - DNA, 97 bp, Artificial Sequence
  Synthetic: Hsa158F
accgtttgtccctgcagcccctaccgccccctccccgagttccccgcgccagcggggataaaccggccctcatctccagctaactgtggagaagccc

SEQ ID NO: 655 - DNA, 97 bp, Artificial Sequence
  Synthetic: Hsa159F
accgagctgagcattgctgagctcggaaatcacctggagttccccgcgccagcggggataaaccgaatggcttcctgtgtctaatgaccctgacaac

SEQ ID NO: 656 - DNA, 97 bp, Artificial Sequence
  Synthetic: Hsa160F
accgactgtttcattcatctctctggaaagcaggtggagttccccgcgccagcggggataaaccgcccagcacggtgcaagcttgtaaccgctttaa

SEQ ID NO: 657 - DNA, 97 bp, Artificial Sequence
  Synthetic: Hsa161F
accgcgtggatgctggcctccctgtggcccacgcacgagttccccgcgccagcggggataaaccgtcaaggagcatggaatcccggcccctcaggag

SEQ ID NO: 658 - DNA, 97 bp, Artificial Sequence
  Synthetic: Hsa162F
accgctgaacagaaggtctcaggaagctccaggaaggagttccccgcgccagcggggataaaccgatgactgtcccagcgagtggcttctctcagac

SEQ ID NO: 659 - DNA, 97 bp, Artificial Sequence
  Synthetic: Hsa163F
accggcagctgaattccccttgagacccaccgctaagagttccccgcgccagcggggataaaccggcatctttagtgatccaaggtaagaaaccctg

SEQ ID NO: 660 - DNA, 97 bp, Artificial Sequence
  Synthetic: Hsa164F
accgggtgtgtgtggagtggggagggggaaataaatgagttccccgcgccagcggggataaaccggacgtccgcgtgttttctctttcagttagctg

SEQ ID NO: 661 - DNA, 97 bp, Artificial Sequence
  Synthetic: Hsa165F
accgagctgagcattgctgagctcggaaatcacctggagttccccgcgccagcggggataaaccggcttcctgtgtctaatgaccctgacaacccat

SEQ ID NO: 662 - DNA, 97 bp, Artificial Sequence
  Synthetic: Hsa166F
accgtgacatgcccctggatgtcctcctccacacaggagttccccgcgccagcggggataaaccgatgcccatcgcgcagccctgcaacatttttga

SEQ ID NO: 663 - DNA, 97 bp, Artificial Sequence
  Synthetic: Hsa167F
accgaagaggttgctacaacctgacagcctgacagagagttccccgcgccagcggggataaaccgggtttatgcgtgtccacagtacaccctccctc

SEQ ID NO: 664 - DNA, 97 bp, Artificial Sequence
  Synthetic: Hsa168F
accggtagcccggggtgagtggcatttcatgagggggagttccccgcgccagcggggataaaccgtaaaatttgagaggaagacaatattaatctgt

SEQ ID NO: 665 - DNA, 97 bp, Artificial Sequence
  Synthetic: Hsa169F
accgttcaggagcagggcgcgtgaaggggcgcgcgggagttccccgcgccagcggggataaaccggcgccgccggcgtggaccgcgcacggcctcta

SEQ ID NO: 666 - DNA, 97 bp, Artificial Sequence
  Synthetic: Hsa170F
accgctggtgtctaggagatacacctccaccaggctgagttccccgcgccagcggggataaaccggtcaccgacttcgagaatgtgcccgaggagga

SEQ ID NO: 667 - DNA, 97 bp, Artificial Sequence
  Synthetic: Hsa171F
accgactgtcacacttgctggcctgctcgacgaacagagttccccgcgccagcggggataaaccgccggcgtggccaagggtgccagcatgcgcagc

SEQ ID NO: 668 - DNA, 97 bp, Artificial Sequence
  Synthetic: Hsa172F
accggctccccgcaggccacctttgggtgttgctaggagttccccgcgccagcggggataaaccgcactgtctcagccaacccgctccactacccgg

SEQ ID NO: 669 - DNA, 97 bp, Artificial Sequence
  Synthetic: Hsa173F
accgcaggatcttggtgaggtatccccggcgggcaggagttccccgcgccagcggggataaaccgagtggcgacctgctggagctggtgagccaccc

SEQ ID NO: 670 - DNA, 97 bp, Artificial Sequence
  Synthetic: Hsa174F
accgctcagccccagcccttgaccctccccagacacgagttccccgcgccagcggggataaaccggcctggcacgaggggatggggatgcttccgcc

SEQ ID NO: 671 - DNA, 97 bp, Artificial Sequence
  Synthetic: Hsa175F
accgagctcaataaaagtcattctgcccacggacatgagttccccgcgccagcggggataaaccggaggcaggattcttcccatggataggggaggg

SEQ ID NO: 672 - DNA, 97 bp, Artificial Sequence
  Synthetic: Hsa176F
accgccattcataaaactggccatggtgcttgacatgagttccccgcgccagcggggataaaccgtgccaagccaaaggaacaaccctggttgttga

SEQ ID NO: 673 - DNA, 97 bp, Artificial Sequence
  Synthetic: Hsa177F
accgctggcctccctgtggcccacgcactggttggggagttccccgcgccagcggggataaaccgtcaaggagcatggaatcccggcccctcaggag

SEQ ID NO: 674 - DNA, 97 bp, Artificial Sequence
  Synthetic: Hsa178F
accgctgctaagtgctcctctgcctgctgtcacatcgagttccccgcgccagcggggataaaccggaatgctgccgtcgggcaactcctggcacact

SEQ ID NO: 675 - DNA, 97 bp, Artificial Sequence
  Synthetic: Hsa179F
accgatctgtaaggaatcatctggctgtagaagaatgagttccccgcgccagcggggataaaccgccaccaatgccttgggatacgactctgtctcc

SEQ ID NO: 676 - DNA, 97 bp, Artificial Sequence
  Synthetic: Hsa180F
accgcagcctggaagcccctgctcaccctgccccacgagttccccgcgccagcggggataaaccgctcagagccctgctgcccacaacagagcactg

SEQ ID NO: 677 - DNA, 97 bp, Artificial Sequence
  Synthetic: Hsa181F
accgcctggcacggaacaagagctcaataaaagtcagagttccccgcgccagcggggataaaccggataggggagggggcggtaggggctgcaggga

SEQ ID NO: 678 - DNA, 97 bp, Artificial Sequence
  Synthetic: Hsa182F
accggaaagttcctgtggagctgagactgttttcacgagttccccgcgccagcggggataaaccgagatactgagaatggctggaccactcacagca

SEQ ID NO: 679 - DNA, 97 bp, Artificial Sequence
  Synthetic: Hsa183F
accgctccaggaagctgccatcagccatgcgctgctgagttccccgcgccagcggggataaaccgcatgcaagaaagatgactgtcccagcgagtgg

SEQ ID NO: 680 - DNA, 97 bp, Artificial Sequence
  Synthetic: Hsa184F
accgaggtgctggccgtccttctcccaggtgatgaggagttccccgcgccagcggggataaaccgatccaccgcctcaagccctcggatgcaggcgt

SEQ ID NO: 681 - DNA, 97 bp, Artificial Sequence
  Synthetic: Hsa185F
accgcgtggatgctggcctccctgtggcccacgcacgagttccccgcgccagcggggataaaccggaatcccggcccctcaggagcaggtgaagagg

SEQ ID NO: 682 - DNA, 97 bp, Artificial Sequence
  Synthetic: Hsa186F
accgagggccatcagcacctttcacactcaccccccgagttccccgcgccagcggggataaaccggaggcttagctttctggatggcatctagccag

SEQ ID NO: 683 - DNA, 97 bp, Artificial Sequence
  Synthetic: Hsa187F
accgtgctcctctgcctgctgtcacatccagtactggagttccccgcgccagcggggataaaccgcatggaatgctgccgtcgggcaactcctggca

SEQ ID NO: 684 - DNA, 97 bp, Artificial Sequence
  Synthetic: Hsa188F
accgcccctggatgtcctcctccacacaggaaactggagttccccgcgccagcggggataaaccgcccatcgcgcagccctgcaacatttttgactg

SEQ ID NO: 685 - DNA, 97 bp, Artificial Sequence
  Synthetic: Hsa189F
accgctctgggcaaagacagaggagtcctcctcgatgagttccccgcgccagcggggataaaccgaataccagccccccggtaagacccccatctgt

SEQ ID NO: 686 - DNA, 97 bp, Artificial Sequence
  Synthetic: Hsa190F
accgaggagcccagccgggtgaagtaagaagaggctgagttccccgcgccagcggggataaaccgctcggtgagtgatggcagaacgatgcctgcag

SEQ ID NO: 687 - DNA, 97 bp, Artificial Sequence
  Synthetic: Hsa191F
accgccccccccacacgaggaggagcacgcggtccagagttccccgcgccagcggggataaaccgtcacttcagtggaagagtggaaatgcatgtac

SEQ ID NO: 688 - DNA, 97 bp, Artificial Sequence
  Synthetic: Hsa192F
accgactgtttcattcatctctctggaaagcaggtggagttccccgcgccagcggggataaaccgcttgtaaccgctttaattgccccccagcctgg

SEQ ID NO: 689 - DNA, 97 bp, Artificial Sequence
  Synthetic: Hsa193F
accggaatctctctcggagcaggcagccagccaatcgagttccccgcgccagcggggataaaccgtgagaggggctgatggaagctgataggcagga

SEQ ID NO: 690 - DNA, 97 bp, Artificial Sequence
  Synthetic: Hsa194F
accgtgctcctctgcctgctgtcacatccagtactggagttccccgcgccagcggggataaaccggaatgctgccgtcgggcaactcctggcacact

SEQ ID NO: 691 - DNA, 97 bp, Artificial Sequence
  Synthetic: Hsa195F
accgtttctctgagaattcagtgcatgcacatacaagagttccccgcgccagcggggataaaccgaaggagctgctgtgtcagaggagccctcgtaa

SEQ ID NO: 692 - DNA, 97 bp, Artificial Sequence
  Synthetic: Hsa196F
accgaatcctggagcgacagaaaagaaatatagaccgagttccccgcgccagcggggataaaccgtgggtttctacacttgcaatgccaccaatgcc

SEQ ID NO: 693 - DNA, 97 bp, Artificial Sequence
  Synthetic: Hsa197F
accgactgtcacacttgctggcctgctcgacgaacagagttccccgcgccagcggggataaaccgggtgccagcatgcgcagcctgcgcgtgctcaa

SEQ ID NO: 694 - DNA, 97 bp, Artificial Sequence
  Synthetic: Hsa198F
accgcctgcaggcatcgttctgccatcactcaccgagagttccccgcgccagcggggataaaccgcttctaaggcatggtcgggggagagggccaac

SEQ ID NO: 695 - DNA, 97 bp, Artificial Sequence
  Synthetic: Hsa199F
accgcaaaacaggtctagaaaagttggctgtaaaaagagttccccgcgccagcggggataaaccggtgactttttaaaataaaaacaaacaaacgtt

SEQ ID NO: 696 - DNA, 97 bp, Artificial Sequence
  Synthetic: Hsa200F
accgctccaggaagctgccatcagccatgcgctgctgagttccccgcgccagcggggataaaccgaaagatgactgtcccagcgagtggcttctctc

SEQ ID NO: 697 - DNA, 97 bp, Artificial Sequence
  Synthetic: Hsa201F
accgctggcctccctgtggcccacgcactggttggggagttccccgcgccagcggggataaaccggaatcccggcccctcaggagcaggtgaagagg

SEQ ID NO: 698 - DNA, 97 bp, Artificial Sequence
  Synthetic: Hsa202F
accgtcactgtgcactggaaagagattgcaagagaggagttccccgcgccagcggggataaaccgcacacaggaggctgtagcccaaaaacaaagcc

SEQ ID NO: 699 - DNA, 97 bp, Artificial Sequence
  Synthetic: Hsa203F
accgacgtctctggtctgtaggccgaccccacatgtgagttccccgcgccagcggggataaaccgagctgtgtcgccagcccaagcccagcacggtg

SEQ ID NO: 700 - DNA, 97 bp, Artificial Sequence
  Synthetic: Hsa204F
accgctgccatcagccatgcgctgcttgcaaagaacgagttccccgcgccagcggggataaaccgcatgcaagaaagatgactgtcccagcgagtgg

SEQ ID NO: 701 - DNA, 97 bp, Artificial Sequence
  Synthetic: Hsa205F
accgaggcttggcttcagagccagcccaatctgcgtgagttccccgcgccagcggggataaaccggggaacacagaccaggaagctcggtgagtgat

SEQ ID NO: 702 - DNA, 97 bp, Artificial Sequence
  Synthetic: Hsa206F
accgtcctcctccacacaggaaactgcccggctctggagttccccgcgccagcggggataaaccgcccatcgcgcagccctgcaacatttttgactg

SEQ ID NO: 703 - DNA, 97 bp, Artificial Sequence
  Synthetic: Hsa207F
accgctccaggaagctgccatcagccatgcgctgctgagttccccgcgccagcggggataaaccgatgactgtcccagcgagtggcttctctcagac

SEQ ID NO: 704 - DNA, 97 bp, Artificial Sequence
  Synthetic: Hsa208F
accgaacactcagtgtcccgctggccagggccaccggagttccccgcgccagcggggataaaccggagaagaagttcagttcagtgacaggtgagcc

SEQ ID NO: 705 - DNA, 97 bp, Artificial Sequence
  Synthetic: Hsa209F
accgctcagccccagcccttgaccctccccagacacgagttccccgcgccagcggggataaaccggggatgcttccgcctttccggggctgctggcc

SEQ ID NO: 706 - DNA, 97 bp, Artificial Sequence
  Synthetic: Hsa210F
accgttccatgcctgcaggcatcgttctgccatcacgagttccccgcgccagcggggataaaccggtcgggggagagggccaacaactgtccctcct

SEQ ID NO: 707 - DNA, 97 bp, Artificial Sequence
  Synthetic: Hsa211F
accgctgaatggaatctctctcggagcaggcagccagagttccccgcgccagcggggataaaccggaagctgataggcaggactggagtgttagcac

SEQ ID NO: 708 - DNA, 97 bp, Artificial Sequence
  Synthetic: Hsa212F
accggaaagttcctgtggagctgagactgttttcacgagttccccgcgccagcggggataaaccggctggaccactcacagcagatttcattgtcaa

SEQ ID NO: 709 - DNA, 97 bp, Artificial Sequence
  Synthetic: Hsa213F
accggggcgcgcggaatcctggctgggagctgggaggagttccccgcgccagcggggataaaccggcgccgccggcgtggaccgcgcacggcctcta

SEQ ID NO: 710 - DNA, 97 bp, Artificial Sequence
  Synthetic: Hsa214F
accgacagaggagtcctcctcgatgtagtcgacatggagttccccgcgccagcggggataaaccgaataccagccccccggtaagacccccatctgt

SEQ ID NO: 711 - DNA, 97 bp, Artificial Sequence
  Synthetic: Hsa215F
accgagctcaataaaagtcattctgcccacggacatgagttccccgcgccagcggggataaaccggataggggagggggcggtaggggctgcaggga

SEQ ID NO: 712 - DNA, 97 bp, Artificial Sequence
  Synthetic: Hsa216F
accgcctgcaggcatcgttctgccatcactcaccgagagttccccgcgccagcggggataaaccggcatggtcgggggagagggccaacaactgtcc

SEQ ID NO: 713 - DNA, 97 bp, Artificial Sequence
  Synthetic: Hsa217F
accgaggagcccagccgggtgaagtaagaagaggctgagttccccgcgccagcggggataaaccggcagaacgatgcctgcaggcatggaacttttt

SEQ ID NO: 714 - DNA, 97 bp, Artificial Sequence
  Synthetic: Hsa218F
accgctgaatggaatctctctcggagcaggcagccagagttccccgcgccagcggggataaaccgctgataggcaggactggagtgttagcaccagt

SEQ ID NO: 715 - DNA, 97 bp, Artificial Sequence
  Synthetic: Hsa219F
accgctgccatcagccatgcgctgcttgcaaagaacgagttccccgcgccagcggggataaaccgaaagatgactgtcccagcgagtggcttctctc

SEQ ID NO: 716 - DNA, 97 bp, Artificial Sequence
  Synthetic: Hsa220F
accgccccccaccacgaagtgcagcttcctctgcctgagttccccgcgccagcggggataaaccgcccctcatcacctgggagaaggacggccagca

SEQ ID NO: 717 - DNA, 97 bp, Artificial Sequence
  Synthetic: Hsa221F
accgactgtcacacttgctggcctgctcgacgaacagagttccccgcgccagcggggataaaccgcgcagcctgcgcgtgctcaactgccaagggaa

SEQ ID NO: 718 - DNA, 97 bp, Artificial Sequence
  Synthetic: Hsa222F
accgctcagccccagcccttgaccctccccagacacgagttccccgcgccagcggggataaaccgcttccgcctttccggggctgctggcctggccc

SEQ ID NO: 719 - DNA, 97 bp, Artificial Sequence
  Synthetic: Hsa223F
accgcatctccgccaggccagtgaatcaggcctggggagttccccgcgccagcggggataaaccgcaagcagacatttatcttttgggtctgtcctc

SEQ ID NO: 720 - DNA, 97 bp, Artificial Sequence
  Synthetic: Hsa224F
accggacgaaaaagaaaggcgagcgagcagcagagcgagttccccgcgccagcggggataaaccgtctgattagcaggagcctgattggctggctgc

SEQ ID NO: 721 - DNA, 97 bp, Artificial Sequence
  Synthetic: Hsa129R
actcgaggggccgggattccatgctccttgactttgcggtttatccccgctggcgcggggaactcacagggaggccagcatccacgcttcctgctgc

SEQ ID NO: 722 - DNA, 97 bp, Artificial Sequence
  Synthetic: Hsa130R
actcatgggttgtcagggtcattagacacaggaagccggtttatccccgctggcgcggggaactcagcaatgctcagctcataatgatgtcaagcac

SEQ ID NO: 723 - DNA, 97 bp, Artificial Sequence
  Synthetic: Hsa131R
actcggctcacctgtcactgaactgaacttcttctccggtttatccccgctggcgcggggaactccactgtgaggccatcggccacccaaggcctac

SEQ ID NO: 724 - DNA, 97 bp, Artificial Sequence
  Synthetic: Hsa132R
actcagcactgcactgctctgatggtaaggtgatgccggtttatccccgctggcgcggggaactcgggcctcacctagctgtgcaacacagacaagt

SEQ ID NO: 725 - DNA, 97 bp, Artificial Sequence
  Synthetic: Hsa133R
actcggccagcagccccggaaaggcggaagcatccccggtttatccccgctggcgcggggaactcaatggttccgacttgtccctctctcagccctc

SEQ ID NO: 726 - DNA, 97 bp, Artificial Sequence
  Synthetic: Hsa134R
actcattagacacaggaagccattcataaaactggccggtttatccccgctggcgcggggaactccaggtgatttccgagctcagcaatgctcagct

SEQ ID NO: 727 - DNA, 97 bp, Artificial Sequence
  Synthetic: Hsa135R
actcacaatggagttacttacataagtgatcaggaccggtttatccccgctggcgcggggaactcatactgtggttgcaattccctatggaagtaga

SEQ ID NO: 728 - DNA, 97 bp, Artificial Sequence
  Synthetic: Hsa136R
actcgctgcgcgatgggcatcttaggggtgtacatgcggtttatccccgctggcgcggggaactcctgtgtggaggaggacatccaggggcatgtca

SEQ ID NO: 729 - DNA, 97 bp, Artificial Sequence
  Synthetic: Hsa137R
actctggctcaccagctccagcaggtcgccactcatcggtttatccccgctggcgcggggaactcacctcaccaagatcctgcatgtcttccatggc

SEQ ID NO: 730 - DNA, 97 bp, Artificial Sequence
  Synthetic: Hsa138R
actcgggtggctcaccagctccagcaggtcgccactcggtttatccccgctggcgcggggaactctcaccaagatcctgcatgtcttccatggcctt

SEQ ID NO: 731 - DNA, 97 bp, Artificial Sequence
  Synthetic: Hsa139R
actctaagcctccattaatcagggagcccccaggggcggtttatccccgctggcgcggggaactcggggggtgagtgtgaaaggtgctgatggccct

SEQ ID NO: 732 - DNA, 97 bp, Artificial Sequence
  Synthetic: Hsa140R
actcccactcgctgggacagtcatctttcttgcatgcggtttatccccgctggcgcggggaactccttcctggagcttcctgagaccttctgttcag

SEQ ID NO: 733 - DNA, 97 bp, Artificial Sequence
  Synthetic: Hsa141R
actccagtacccgctggtcctcagggaaccaggcctcggtttatccccgctggcgcggggaactcaccctggccgagttgaggcagagactgatcca

SEQ ID NO: 734 - DNA, 97 bp, Artificial Sequence
  Synthetic: Hsa142R
actcccctcccctatccatgggaagaatcctgcctccggtttatccccgctggcgcggggaactctgacttttattgagctcttgttccgtgccagg

SEQ ID NO: 735 - DNA, 97 bp, Artificial Sequence
  Synthetic: Hsa143R
actccagggctgcgcgatgggcatcttaggggtgtacggtttatccccgctggcgcggggaactcctgtgtggaggaggacatccaggggcatgtca

SEQ ID NO: 736 - DNA, 97 bp, Artificial Sequence
  Synthetic: Hsa144R
actcctccttcttctagctcttgagcttgtttgaaccggtttatccccgctggcgcggggaactcttgtatgtgcatgcactgaattctcagagaaa

SEQ ID NO: 737 - DNA, 97 bp, Artificial Sequence
  Synthetic: Hsa145R
actcgggccaggccagcagccccggaaaggcggaagcggtttatccccgctggcgcggggaactcaatggttccgacttgtccctctctcagccctc

SEQ ID NO: 738 - DNA, 97 bp, Artificial Sequence
  Synthetic: Hsa146R
actcttggcaggcacgccccctctggttccaggtttcggtttatccccgctggcgcggggaactcagccaacccgctccactacccggcagggtaca

SEQ ID NO: 739 - DNA, 97 bp, Artificial Sequence
  Synthetic: Hsa147R
actcagttgaatgagaacaaatcagcacttacttggcggtttatccccgctggcgcggggaactcggtcttagatggtacgcgttgctatacagaat

SEQ ID NO: 740 - DNA, 97 bp, Artificial Sequence
  Synthetic: Hsa148R
actcgaagccactcgctgggacagtcatctttcttgcggtttatccccgctggcgcggggaactccttcctggagcttcctgagaccttctgttcag

SEQ ID NO: 741 - DNA, 97 bp, Artificial Sequence
  Synthetic: Hsa149R
actctggctcaccagctccagcaggtcgccactcatcggtttatccccgctggcgcggggaactcggggatacctcaccaagatcctgcatgtcttc

SEQ ID NO: 742 - DNA, 97 bp, Artificial Sequence
  Synthetic: Hsa150R
actcacctgctcctgaggggccgggattccatgctccggtttatccccgctggcgcggggaactcacagggaggccagcatccacgcttcctgctgc

SEQ ID NO: 743 - DNA, 97 bp, Artificial Sequence
  Synthetic: Hsa151R
actcttgctgagcaaggaaagaaatccgtctccctccggtttatccccgctggcgcggggaactcaactcgggctccgctgacagtacagtccagtt

SEQ ID NO: 744 - DNA, 97 bp, Artificial Sequence
  Synthetic: Hsa152R
actcttacgagggctcctctgacacagcagctccttcggtttatccccgctggcgcggggaactcctcagagaaacttccagtcgaggccaagttgc

SEQ ID NO: 745 - DNA, 97 bp, Artificial Sequence
  Synthetic: Hsa153R
actcgtggaaggtggctgtggttccgtgctcgggtgcggtttatccccgctggcgcggggaactcgaggacggcgactacgaggagctggtgctagc

SEQ ID NO: 746 - DNA, 97 bp, Artificial Sequence
  Synthetic: Hsa154R
actcacctatgagggtgccgctaaccgtgcccttcccggtttatccccgctggcgcggggaactcggccgggatgccggcgtggccaagggtgccag

SEQ ID NO: 747 - DNA, 97 bp, Artificial Sequence
  Synthetic: Hsa155R
actcagtcggaaccattttaaagctcagccccagcccggtttatccccgctggcgcggggaactccgcaggcctcccaggagctccagtgacagccc

SEQ ID NO: 748 - DNA, 97 bp, Artificial Sequence
  Synthetic: Hsa156R
actctcctgcctatcagcttccatcagcccctctcacggtttatccccgctggcgcggggaactccgagagagattccattcagcttaccccccacc

SEQ ID NO: 749 - DNA, 97 bp, Artificial Sequence
  Synthetic: Hsa157R
actctggctcaccagctccagcaggtcgccactcatcggtttatccccgctggcgcggggaactccgccggggatacctcaccaagatcctgcatgt

SEQ ID NO: 750 - DNA, 97 bp, Artificial Sequence
  Synthetic: Hsa158R
actcgggcttctccacagttagctggagatgagggccggtttatccccgctggcgcggggaactcggggagggggcggtaggggctgcagggacaaa

SEQ ID NO: 751 - DNA, 97 bp, Artificial Sequence
  Synthetic: Hsa159R
actcgttgtcagggtcattagacacaggaagccattcggtttatccccgctggcgcggggaactccaggtgatttccgagctcagcaatgctcagct

SEQ ID NO: 752 - DNA, 97 bp, Artificial Sequence
  Synthetic: Hsa160R
actcttaaagcggttacaagcttgcaccgtgctgggcggtttatccccgctggcgcggggaactccacctgctttccagagagatgaatgaaacagt

SEQ ID NO: 753 - DNA, 97 bp, Artificial Sequence
  Synthetic: Hsa161R
actcctcctgaggggccgggattccatgctccttgacggtttatccccgctggcgcggggaactcgtgcgtgggccacagggaggccagcatccacg

SEQ ID NO: 754 - DNA, 97 bp, Artificial Sequence
  Synthetic: Hsa162R
actcgtctgagagaagccactcgctgggacagtcatcggtttatccccgctggcgcggggaactccttcctggagcttcctgagaccttctgttcag

SEQ ID NO: 755 - DNA, 97 bp, Artificial Sequence
  Synthetic: Hsa163R
actccagggtttcttaccttggatcactaaagatgccggtttatccccgctggcgcggggaactcttagcggtgggtctcaaggggaattcagctgc

SEQ ID NO: 756 - DNA, 97 bp, Artificial Sequence
  Synthetic: Hsa164R
actccagctaactgaaagagaaaacacgcggacgtccggtttatccccgctggcgcggggaactcatttatttccccctccccactccacacacacc

SEQ ID NO: 757 - DNA, 97 bp, Artificial Sequence
  Synthetic: Hsa165R
actcatgggttgtcagggtcattagacacaggaagccggtttatccccgctggcgcggggaactccaggtgatttccgagctcagcaatgctcagct

SEQ ID NO: 758 - DNA, 97 bp, Artificial Sequence
  Synthetic: Hsa166R
actctcaaaaatgttgcagggctgcgcgatgggcatcggtttatccccgctggcgcggggaactcctgtgtggaggaggacatccaggggcatgtca

SEQ ID NO: 759 - DNA, 97 bp, Artificial Sequence
  Synthetic: Hsa167R
actcgagggagggtgtactgtggacacgcataaacccggtttatccccgctggcgcggggaactctctgtcaggctgtcaggttgtagcaacctctt

SEQ ID NO: 760 - DNA, 97 bp, Artificial Sequence
  Synthetic: Hsa168R
actcacagattaatattgtcttcctctcaaattttacggtttatccccgctggcgcggggaactccccctcatgaaatgccactcaccccgggctac

SEQ ID NO: 761 - DNA, 97 bp, Artificial Sequence
  Synthetic: Hsa169R
actctagaggccgtgcgcggtccacgccggcggcgccggtttatccccgctggcgcggggaactcccgcgcgccccttcacgcgccctgctcctgaa

SEQ ID NO: 762 - DNA, 97 bp, Artificial Sequence
  Synthetic: Hsa170R
actctcctcctcgggcacattctcgaagtcggtgaccggtttatccccgctggcgcggggaactcagcctggtggaggtgtatctcctagacaccag

SEQ ID NO: 763 - DNA, 97 bp, Artificial Sequence
  Synthetic: Hsa171R
actcgctgcgcatgctggcacccttggccacgccggcggtttatccccgctggcgcggggaactctgttcgtcgagcaggccagcaagtgtgacagt

SEQ ID NO: 764 - DNA, 97 bp, Artificial Sequence
  Synthetic: Hsa172R
actcccgggtagtggagcgggttggctgagacagtgcggtttatccccgctggcgcggggaactcctagcaacacccaaaggtggcctgcggggagc

SEQ ID NO: 765 - DNA, 97 bp, Artificial Sequence
  Synthetic: Hsa173R
actcgggtggctcaccagctccagcaggtcgccactcggtttatccccgctggcgcggggaactcctgcccgccggggatacctcaccaagatcctg

SEQ ID NO: 766 - DNA, 97 bp, Artificial Sequence
  Synthetic: Hsa174R
actcggcggaagcatccccatcccctcgtgccaggccggtttatccccgctggcgcggggaactcgtgtctggggagggtcaagggctggggctgag

SEQ ID NO: 767 - DNA, 97 bp, Artificial Sequence
  Synthetic: Hsa175R
actcccctcccctatccatgggaagaatcctgcctccggtttatccccgctggcgcggggaactcatgtccgtgggcagaatgacttttattgagct

SEQ ID NO: 768 - DNA, 97 bp, Artificial Sequence
  Synthetic: Hsa176R
actctcaacaaccagggttgttcctttggcttggcacggtttatccccgctggcgcggggaactcatgtcaagcaccatggccagttttatgaatgg

SEQ ID NO: 769 - DNA, 97 bp, Artificial Sequence
  Synthetic: Hsa177R
actcctcctgaggggccgggattccatgctccttgacggtttatccccgctggcgcggggaactccccaaccagtgcgtgggccacagggaggccag

SEQ ID NO: 770 - DNA, 97 bp, Artificial Sequence
  Synthetic: Hsa178R
actcagtgtgccaggagttgcccgacggcagcattccggtttatccccgctggcgcggggaactcgatgtgacagcaggcagaggagcacttagcag

SEQ ID NO: 771 - DNA, 97 bp, Artificial Sequence
  Synthetic: Hsa179R
actcggagacagagtcgtatcccaaggcattggtggcggtttatccccgctggcgcggggaactcattcttctacagccagatgattccttacagat

SEQ ID NO: 772 - DNA, 97 bp, Artificial Sequence
  Synthetic: Hsa180R
actccagtgctctgttgtgggcagcagggctctgagcggtttatccccgctggcgcggggaactcgtggggcagggtgagcaggggcttccaggctg

SEQ ID NO: 773 - DNA, 97 bp, Artificial Sequence
  Synthetic: Hsa181R
actctccctgcagcccctaccgccccctcccctatccggtttatccccgctggcgcggggaactctgacttttattgagctcttgttccgtgccagg

SEQ ID NO: 774 - DNA, 97 bp, Artificial Sequence
  Synthetic: Hsa182R
actctgctgtgagtggtccagccattctcagtatctcggtttatccccgctggcgcggggaactcgtgaaaacagtctcagctccacaggaactttc

SEQ ID NO: 775 - DNA, 97 bp, Artificial Sequence
  Synthetic: Hsa183R
actcccactcgctgggacagtcatctttcttgcatgcggtttatccccgctggcgcggggaactcagcagcgcatggctgatggcagcttcctggag

SEQ ID NO: 776 - DNA, 97 bp, Artificial Sequence
  Synthetic: Hsa184R
actcacgcctgcatccgagggcttgaggcggtggatcggtttatccccgctggcgcggggaactcctcatcacctgggagaaggacggccagcacct

SEQ ID NO: 777 - DNA, 97 bp, Artificial Sequence
  Synthetic: Hsa185R
actccctcttcacctgctcctgaggggccgggattccggtttatccccgctggcgcggggaactcgtgcgtgggccacagggaggccagcatccacg

SEQ ID NO: 778 - DNA, 97 bp, Artificial Sequence
  Synthetic: Hsa186R
actcctggctagatgccatccagaaagctaagcctccggtttatccccgctggcgcggggaactcggggggtgagtgtgaaaggtgctgatggccct

SEQ ID NO: 779 - DNA, 97 bp, Artificial Sequence
  Synthetic: Hsa187R
actctgccaggagttgcccgacggcagcattccatgcggtttatccccgctggcgcggggaactccagtactggatgtgacagcaggcagaggagca

SEQ ID NO: 780 - DNA, 97 bp, Artificial Sequence
  Synthetic: Hsa188R
actccagtcaaaaatgttgcagggctgcgcgatgggcggtttatccccgctggcgcggggaactccagtttcctgtgtggaggaggacatccagggg

SEQ ID NO: 781 - DNA, 97 bp, Artificial Sequence
  Synthetic: Hsa189R
actcacagatgggggtcttaccggggggctggtattcggtttatccccgctggcgcggggaactcatcgaggaggactcctctgtctttgcccagag

SEQ ID NO: 782 - DNA, 97 bp, Artificial Sequence
  Synthetic: Hsa190R
actcctgcaggcatcgttctgccatcactcaccgagcggtttatccccgctggcgcggggaactcagcctcttcttacttcacccggctgggctcct

SEQ ID NO: 783 - DNA, 97 bp, Artificial Sequence
  Synthetic: Hsa191R
actcgtacatgcatttccactcttccactgaagtgacggtttatccccgctggcgcggggaactctggaccgcgtgctcctcctcgtgtgggggggg

SEQ ID NO: 784 - DNA, 97 bp, Artificial Sequence
  Synthetic: Hsa192R
actcccaggctggggggcaattaaagcggttacaagcggtttatccccgctggcgcggggaactccacctgctttccagagagatgaatgaaacagt

SEQ ID NO: 785 - DNA, 97 bp, Artificial Sequence
  Synthetic: Hsa193R
actctcctgcctatcagcttccatcagcccctctcacggtttatccccgctggcgcggggaactcgattggctggctgcctgctccgagagagattc

SEQ ID NO: 786 - DNA, 97 bp, Artificial Sequence
  Synthetic: Hsa194R
actcagtgtgccaggagttgcccgacggcagcattccggtttatccccgctggcgcggggaactccagtactggatgtgacagcaggcagaggagca

SEQ ID NO: 787 - DNA, 97 bp, Artificial Sequence
  Synthetic: Hsa195R
actcttacgagggctcctctgacacagcagctccttcggtttatccccgctggcgcggggaactcttgtatgtgcatgcactgaattctcagagaaa

SEQ ID NO: 788 - DNA, 97 bp, Artificial Sequence
  Synthetic: Hsa196R
actcggcattggtggcattgcaagtgtagaaacccacggtttatccccgctggcgcggggaactcggtctatatttcttttctgtcgctccaggatt

SEQ ID NO: 789 - DNA, 97 bp, Artificial Sequence
  Synthetic: Hsa197R
actcttgagcacgcgcaggctgcgcatgctggcacccggtttatccccgctggcgcggggaactctgttcgtcgagcaggccagcaagtgtgacagt

SEQ ID NO: 790 - DNA, 97 bp, Artificial Sequence
  Synthetic: Hsa198R
actcgttggccctctcccccgaccatgccttagaagcggtttatccccgctggcgcggggaactctcggtgagtgatggcagaacgatgcctgcagg

SEQ ID NO: 791 - DNA, 97 bp, Artificial Sequence
  Synthetic: Hsa199R
actcaacgtttgtttgtttttattttaaaaagtcaccggtttatccccgctggcgcggggaactctttttacagccaacttttctagacctgttttg

SEQ ID NO: 792 - DNA, 97 bp, Artificial Sequence
  Synthetic: Hsa200R
actcgagagaagccactcgctgggacagtcatctttcggtttatccccgctggcgcggggaactcagcagcgcatggctgatggcagcttcctggag

SEQ ID NO: 793 - DNA, 97 bp, Artificial Sequence
  Synthetic: Hsa201R
actccctcttcacctgctcctgaggggccgggattccggtttatccccgctggcgcggggaactccccaaccagtgcgtgggccacagggaggccag

SEQ ID NO: 794 - DNA, 97 bp, Artificial Sequence
  Synthetic: Hsa202R
actcggctttgtttttgggctacagcctcctgtgtgcggtttatccccgctggcgcggggaactcctctcttgcaatctctttccagtgcacagtga

SEQ ID NO: 795 - DNA, 97 bp, Artificial Sequence
  Synthetic: Hsa203R
actccaccgtgctgggcttgggctggcgacacagctcggtttatccccgctggcgcggggaactcacatgtggggtcggcctacagaccagagacgt

SEQ ID NO: 796 - DNA, 97 bp, Artificial Sequence
  Synthetic: Hsa204R
actcccactcgctgggacagtcatctttcttgcatgcggtttatccccgctggcgcggggaactcgttctttgcaagcagcgcatggctgatggcag

SEQ ID NO: 797 - DNA, 97 bp, Artificial Sequence
  Synthetic: Hsa205R
actcatcactcaccgagcttcctggtctgtgttccccggtttatccccgctggcgcggggaactcacgcagattgggctggctctgaagccaagcct

SEQ ID NO: 798 - DNA, 97 bp, Artificial Sequence
  Synthetic: Hsa206R
actccagtcaaaaatgttgcagggctgcgcgatgggcggtttatccccgctggcgcggggaactccagagccgggcagtttcctgtgtggaggagga

SEQ ID NO: 799 - DNA, 97 bp, Artificial Sequence
  Synthetic: Hsa207R
actcgtctgagagaagccactcgctgggacagtcatcggtttatccccgctggcgcggggaactcagcagcgcatggctgatggcagcttcctggag

SEQ ID NO: 800 - DNA, 97 bp, Artificial Sequence
  Synthetic: Hsa208R
actcggctcacctgtcactgaactgaacttcttctccggtttatccccgctggcgcggggaactccggtggccctggccagcgggacactgagtgtt

SEQ ID NO: 801 - DNA, 97 bp, Artificial Sequence
  Synthetic: Hsa209R
actcggccagcagccccggaaaggcggaagcatccccggtttatccccgctggcgcggggaactcgtgtctggggagggtcaagggctggggctgag

SEQ ID NO: 802 - DNA, 97 bp, Artificial Sequence
  Synthetic: Hsa210R
actcaggagggacagttgttggccctctcccccgaccggtttatccccgctggcgcggggaactcgtgatggcagaacgatgcctgcaggcatggaa

SEQ ID NO: 803 - DNA, 97 bp, Artificial Sequence
  Synthetic: Hsa211R
actcgtgctaacactccagtcctgcctatcagcttccggtttatccccgctggcgcggggaactctggctgcctgctccgagagagattccattcag

SEQ ID NO: 804 - DNA, 97 bp, Artificial Sequence
  Synthetic: Hsa212R
actcttgacaatgaaatctgctgtgagtggtccagccggtttatccccgctggcgcggggaactcgtgaaaacagtctcagctccacaggaactttc

SEQ ID NO: 805 - DNA, 97 bp, Artificial Sequence
  Synthetic: Hsa213R
actctagaggccgtgcgcggtccacgccggcggcgccggtttatccccgctggcgcggggaactcctcccagctcccagccaggattccgcgcgccc

SEQ ID NO: 806 - DNA, 97 bp, Artificial Sequence
  Synthetic: Hsa214R
actcacagatgggggtcttaccggggggctggtattcggtttatccccgctggcgcggggaactccatgtcgactacatcgaggaggactcctctgt

SEQ ID NO: 807 - DNA, 97 bp, Artificial Sequence
  Synthetic: Hsa215R
actctccctgcagcccctaccgccccctcccctatccggtttatccccgctggcgcggggaactcatgtccgtgggcagaatgacttttattgagct

SEQ ID NO: 808 - DNA, 97 bp, Artificial Sequence
  Synthetic: Hsa216R
actcggacagttgttggccctctcccccgaccatgccggtttatccccgctggcgcggggaactctcggtgagtgatggcagaacgatgcctgcagg

SEQ ID NO: 809 - DNA, 97 bp, Artificial Sequence
  Synthetic: Hsa217R
actcaaaaagttccatgcctgcaggcatcgttctgccggtttatccccgctggcgcggggaactcagcctcttcttacttcacccggctgggctcct

SEQ ID NO: 810 - DNA, 97 bp, Artificial Sequence
  Synthetic: Hsa218R
actcactggtgctaacactccagtcctgcctatcagcggtttatccccgctggcgcggggaactctggctgcctgctccgagagagattccattcag

SEQ ID NO: 811 - DNA, 97 bp, Artificial Sequence
  Synthetic: Hsa219R
actcgagagaagccactcgctgggacagtcatctttcggtttatccccgctggcgcggggaactcgttctttgcaagcagcgcatggctgatggcag

SEQ ID NO: 812 - DNA, 97 bp, Artificial Sequence
  Synthetic: Hsa220R
actctgctggccgtccttctcccaggtgatgaggggcggtttatccccgctggcgcggggaactcaggcagaggaagctgcacttcgtggtgggggg

SEQ ID NO: 813 - DNA, 97 bp, Artificial Sequence
  Synthetic: Hsa221R
actcttcccttggcagttgagcacgcgcaggctgcgcggtttatccccgctggcgcggggaactctgttcgtcgagcaggccagcaagtgtgacagt

SEQ ID NO: 814 - DNA, 97 bp, Artificial Sequence
  Synthetic: Hsa222R
actcgggccaggccagcagccccggaaaggcggaagcggtttatccccgctggcgcggggaactcgtgtctggggagggtcaagggctggggctgag

SEQ ID NO: 815 - DNA, 97 bp, Artificial Sequence
  Synthetic: Hsa223R
actcgaggacagacccaaaagataaatgtctgcttgcggtttatccccgctggcgcggggaactccccaggcctgattcactggcctggcggagatg

SEQ ID NO: 816 - DNA, 97 bp, Artificial Sequence
  Synthetic: Hsa224R
actcgcagccagccaatcaggctcctgctaatcagacggtttatccccgctggcgcggggaactcgctctgctgctcgctcgcctttctttttcgtc

SEQ ID NO: 817 - protein, 5 aa, Artificial Sequence
  Synthetic: Linker
GGGGS

SEQ ID NO: 818 - protein, 8 aa, Artificial Sequence
  Synthetic: Linker
TGPGAAAR

SEQ ID NO: 819 - protein, 10 aa, Artificial Sequence
  Synthetic: Linker
GGSGSSGGSG

SEQ ID NO: 820 - protein, 15 aa, Artificial Sequence
  Synthetic: Linker
GGSGSSGGSGSSGGS

SEQ ID NO: 821 - protein, 17 aa, Artificial Sequence
  Synthetic: Linker
ADPTNRAKGLEAVSVAS

SEQ ID NO: 822 - protein, 20 aa, Artificial Sequence
  Synthetic: Linker
SGSETPGTSESATPESGGSG

SEQ ID NO: 823 - protein, 40 aa, Artificial Sequence
  Synthetic: Linker
SGSETPGTSESATPESGGSGSSGGSGSSGGSGSSGGSGSS

SEQ ID NO: 824 - protein, 50 aa, Artificial Sequence
  Synthetic: Linker
SGSETPGTSESATPESGGSGSSGGSGSSGGSGSSGGSGSSGGSGSSGGSG

SEQ ID NO: 825 - DNA, 50 bp, Artificial Sequence
  Synthetic: Hsa129_F_ilmn (Illumina)
cactctttccctacacgacgctcttccgatctgaccttggcacccacaag

SEQ ID NO: 826 - DNA, 52 bp, Artificial Sequence
  Synthetic: Hsa130_F_ilmn (Illumina)
cactctttccctacacgacgctcttccgatcttgctctggtttcatgtttgg

SEQ ID NO: 827 - DNA, 50 bp, Artificial Sequence
  Synthetic: Hsa131_F_ilmn (Illumina)
cactctttccctacacgacgctcttccgatctccagcagctctcagcctc

SEQ ID NO: 828 - DNA, 52 bp, Artificial Sequence
  Synthetic: Hsa132_F_ilmn (Illumina)
cactctttccctacacgacgctcttccgatctctccacccttgacttggcta

SEQ ID NO: 829 - DNA, 51 bp, Artificial Sequence
  Synthetic: Hsa133_F_ilmn (Illumina)
cactctttccctacacgacgctcttccgatctcaggagctccagtgacagc

SEQ ID NO: 830 - DNA, 52 bp, Artificial Sequence; identical to SEQ ID NO: 826
  Synthetic: Hsa134_F_ilmn (Illumina)

SEQ ID NO: 831 - DNA, 55 bp, Artificial Sequence
  Synthetic: Hsa135_F_ilmn (Illumina)
cactctttccctacacgacgctcttccgatcttttaaggtatggaagtcagtgcc

SEQ ID NO: 832 - DNA, 52 bp, Artificial Sequence
  Synthetic: Hsa136_F_ilmn (Illumina)
cactctttccctacacgacgctcttccgatctttgcttctgtaggtgggagg

SEQ ID NO: 833 - DNA, 52 bp, Artificial Sequence
  Synthetic: Hsa137_F_ilmn (Illumina)
cactctttccctacacgacgctcttccgatctgtggtgctgaaggaggagac

SEQ ID NO: 834 - DNA, 52 bp, Artificial Sequence; identical to SEQ ID NO: 833
  Synthetic: Hsa138_F_ilmn (Illumina)

SEQ ID NO: 835 - DNA, 52 bp, Artificial Sequence
  Synthetic: Hsa139_F_ilmn (Illumina)
cactctttccctacacgacgctcttccgatcttcaatcctcaggtctccacc

SEQ ID NO: 836 - DNA, 52 bp, Artificial Sequence
  Synthetic: Hsa140_F_ilmn (Illumina)
cactctttccctacacgacgctcttccgatctccagtgttccagaacgtgtg

SEQ ID NO: 837 - DNA, 52 bp, Artificial Sequence
  Synthetic: Hsa141_F_ilmn (Illumina)
cactctttccctacacgacgctcttccgatctccatctttcaccattcaccc

SEQ ID NO: 838 - DNA, 52 bp, Artificial Sequence
  Synthetic: Hsa142_F_ilmn (Illumina)
cactctttccctacacgacgctcttccgatctgggcatttcaccattcaaac

SEQ ID NO: 839 - DNA, 52 bp, Artificial Sequence; identical to SEQ ID NO: 832
  Synthetic: Hsa143_F_ilmn (Illumina)

SEQ ID NO: 840 - DNA, 52 bp, Artificial Sequence
  Synthetic: Hsa144_F_ilmn (Illumina)
cactctttccctacacgacgctcttccgatctgaggcagcaatttacccaaa

SEQ ID NO: 841 - DNA, 51 bp, Artificial Sequence; identical to SEQ ID NO: 829
  Synthetic: Hsa145_F_ilmn (Illumina)

SEQ ID NO: 842 - DNA, 52 bp, Artificial Sequence
  Synthetic: Hsa146_F_ilmn (Illumina)
cactctttccctacacgacgctcttccgatcttgtgctagcaacacccaaag

SEQ ID NO: 843 - DNA, 52 bp, Artificial Sequence
  Synthetic: Hsa147_F_ilmn (Illumina)
cactctttccctacacgacgctcttccgatcttgttcactcaagtgccaagc

SEQ ID NO: 844 - DNA, 52 bp, Artificial Sequence; identical to SEQ ID NO: 836
  Synthetic: Hsa148_F_ilmn (Illumina)

SEQ ID NO: 845 - DNA, 52 bp, Artificial Sequence; identical to SEQ ID NO: 833
  Synthetic: Hsa149_F_ilmn (Illumina)

SEQ ID NO: 846 - DNA, 50 bp, Artificial Sequence; identical to SEQ ID NO: 825
  Synthetic: Hsa150_F_ilmn (Illumina)

SEQ ID NO: 847 - DNA, 52 bp, Artificial Sequence
  Synthetic: Hsa151_F_ilmn (Illumina)
cactctttccctacacgacgctcttccgatctagcaccgcactgtcacatta

SEQ ID NO: 848 - DNA, 55 bp, Artificial Sequence
  Synthetic: Hsa152_F_ilmn (Illumina)
cactctttccctacacgacgctcttccgatctaatcccagattggttctaacctc

SEQ ID NO: 849 - DNA, 51 bp, Artificial Sequence
  Synthetic: Hsa153_F_ilmn (Illumina)
cactctttccctacacgacgctcttccgatctgacagcaacctctcccctg

SEQ ID NO: 850 - DNA, 52 bp, Artificial Sequence
  Synthetic: Hsa154_F_ilmn (Illumina)
cactctttccctacacgacgctcttccgatctagtgtgacagtcatggcacc

SEQ ID NO: 851 - DNA, 52 bp, Artificial Sequence
  Synthetic: Hsa155_F_ilmn (Illumina)
cactctttccctacacgacgctcttccgatctgtcagcactacaggcagcac

SEQ ID NO: 852 - DNA, 52 bp, Artificial Sequence
  Synthetic: Hsa156_F_ilmn (Illumina)
cactctttccctacacgacgctcttccgatcttctgtcctcctggctttgtt

SEQ ID NO: 853 - DNA, 52 bp, Artificial Sequence; identical to SEQ ID NO: 833
  Synthetic: Hsa157_F_ilmn (Illumina)

SEQ ID NO: 854 - DNA, 52 bp, Artificial Sequence; identical to SEQ ID NO: 835
  Synthetic: Hsa158_F_ilmn (Illumina)

SEQ ID NO: 855 - DNA, 52 bp, Artificial Sequence; identical to SEQ ID NO: 826
  Synthetic: Hsa159_F_ilmn (Illumina)

SEQ ID NO: 856 - DNA, 52 bp, Artificial Sequence
  Synthetic: Hsa160_F_ilmn (Illumina)
cactctttccctacacgacgctcttccgatcttcggcctacagaccagagac

SEQ ID NO: 857 - DNA, 50 bp, Artificial Sequence; identical to SEQ ID NO: 825
  Synthetic: Hsa161_F_ilmn (Illumina)

SEQ ID NO: 858 - DNA, 52 bp, Artificial Sequence; identical to SEQ ID NO: 836
  Synthetic: Hsa162_F_ilmn (Illumina)

SEQ ID NO: 859 - DNA, 52 bp, Artificial Sequence
  Synthetic: Hsa163_F_ilmn (Illumina)
cactctttccctacacgacgctcttccgatctactgacgcatcacatcttgg

SEQ ID NO: 860 - DNA, 52 bp, Artificial Sequence
  Synthetic: Hsa164_F_ilmn (Illumina)
cactctttccctacacgacgctcttccgatctatctcgctgctgtggaactt

SEQ ID NO: 861 - DNA, 52 bp, Artificial Sequence; identical to SEQ ID NO: 826
  Synthetic: Hsa165_F_ilmn (Illumina)

SEQ ID NO: 862 - DNA, 52 bp, Artificial Sequence; identical to SEQ ID NO: 832
  Synthetic: Hsa166_F_ilmn (Illumina)

SEQ ID NO: 863 - DNA, 52 bp, Artificial Sequence
  Synthetic: Hsa167_F_ilmn (Illumina)
cactctttccctacacgacgctcttccgatcttaggacctttgctgctccac

SEQ ID NO: 864 - DNA, 52 bp, Artificial Sequence
  Synthetic: Hsa168_F_ilmn (Illumina)
cactctttccctacacgacgctcttccgatctaatcctcattaagccgagca

SEQ ID NO: 865 - DNA, 52 bp, Artificial Sequence
  Synthetic: Hsa169_F_ilmn (Illumina)
cactctttccctacacgacgctcttccgatctgtctgagcctggaggagtga

SEQ ID NO: 866 - DNA, 52 bp, Artificial Sequence
  Synthetic: Hsa170_F_ilmn (Illumina)
cactctttccctacacgacgctcttccgatctacaaatgtcgccttggaaag

SEQ ID NO: 867 - DNA, 52 bp, Artificial Sequence
  Synthetic: Hsa171_F_ilmn (Illumina)
cactctttccctacacgacgctcttccgatctgggtctttctcatgtggtcc

SEQ ID NO: 868 - DNA, 52 bp, Artificial Sequence
  Synthetic: Hsa172_F_ilmn (Illumina)
cactctttccctacacgacgctcttccgatctactctgctctatgccaggct

SEQ ID NO: 869 - DNA, 52 bp, Artificial Sequence; identical to SEQ ID NO: 833
  Synthetic: Hsa173_F_ilmn (Illumina)

SEQ ID NO: 870 - DNA, 51 bp, Artificial Sequence; identical to SEQ ID NO: 829
  Synthetic: Hsa174_F_ilmn (Illumina)

SEQ ID NO: 871 - DNA, 52 bp, Artificial Sequence; identical to SEQ ID NO: 838
  Synthetic: Hsa175_F_ilmn (Illumina)

SEQ ID NO: 872 - DNA, 52 bp, Artificial Sequence
  Synthetic: Hsa176_F_ilmn (Illumina)
cactctttccctacacgacgctcttccgatctagaagcaggtgatttccgag

SEQ ID NO: 873 - DNA, 50 bp, Artificial Sequence; identical to SEQ ID NO: 825
  Synthetic: Hsa177_F_ilmn (Illumina)

SEQ ID NO: 874 - DNA, 52 bp, Artificial Sequence
  Synthetic: Hsa178_F_ilmn (Illumina)
cactctttccctacacgacgctcttccgatctgctgataggcaggactggag

SEQ ID NO: 875 - DNA, 52 bp, Artificial Sequence
  Synthetic: Hsa179_F_ilmn (Illumina)
cactctttccctacacgacgctcttccgatctacaccctgaggttccttcct

SEQ ID NO: 876 - DNA, 52 bp, Artificial Sequence
  Synthetic: Hsa180_F_ilmn (Illumina)
cactctttccctacacgacgctcttccgatctaggcacacaacattgcagaa

SEQ ID NO: 877 - DNA, 52 bp, Artificial Sequence; identical to SEQ ID NO: 838
  Synthetic: Hsa181_F_ilmn (Illumina)

SEQ ID NO: 878 - DNA, 52 bp, Artificial Sequence
  Synthetic: Hsa182_F_ilmn (Illumina)
cactctttccctacacgacgctcttccgatctatgaaatgtgcttgcctgtg

SEQ ID NO: 879 - DNA, 52 bp, Artificial Sequence; identical to SEQ ID NO: 836
  Synthetic: Hsa183_F_ilmn (Illumina)

SEQ ID NO: 880 - DNA, 52 bp, Artificial Sequence
  Synthetic: Hsa184_F_ilmn (Illumina)
cactctttccctacacgacgctcttccgatctcatacagactcgcaggcaga

SEQ ID NO: 881 - DNA, 50 bp, Artificial Sequence; identical to SEQ ID NO: 825
  Synthetic: Hsa185_F_ilmn (Illumina)

SEQ ID NO: 882 - DNA, 52 bp, Artificial Sequence; identical to SEQ ID NO: 835
  Synthetic: Hsa186_F_ilmn (Illumina)

SEQ ID NO: 883 - DNA, 52 bp, Artificial Sequence; identical to SEQ ID NO: 874
  Synthetic: Hsa187_F_ilmn (Illumina)

SEQ ID NO: 884 - DNA, 52 bp, Artificial Sequence; identical to SEQ ID NO: 832
  Synthetic: Hsa188_F_ilmn (Illumina)

SEQ ID NO: 885 - DNA, 52 bp, Artificial Sequence
  Synthetic: Hsa189_F_ilmn (Illumina)
cactctttccctacacgacgctcttccgatctcttctgcaggccttgaagtt

SEQ ID NO: 886 - DNA, 52 bp, Artificial Sequence
  Synthetic: Hsa190_F_ilmn (Illumina)
cactctttccctacacgacgctcttccgatctgcaggaactgagccagaaac

SEQ ID NO: 887 - DNA, 52 bp, Artificial Sequence; identical to SEQ ID NO: 832
  Synthetic: Hsa191_F_ilmn (Illumina)

SEQ ID NO: 888 - DNA, 52 bp, Artificial Sequence; identical to SEQ ID NO: 856
  Synthetic: Hsa192_F_ilmn (Illumina)

SEQ ID NO: 889 - DNA, 52 bp, Artificial Sequence; identical to SEQ ID NO: 852
  Synthetic: Hsa193_F_ilmn (Illumina)

SEQ ID NO: 890 - DNA, 52 bp, Artificial Sequence; identical to SEQ ID NO: 874
  Synthetic: Hsa194_F_ilmn (Illumina)

SEQ ID NO: 891 - DNA, 55 bp, Artificial Sequence; identical to SEQ ID NO: 848
  Synthetic: Hsa195_F_ilmn (Illumina)

SEQ ID NO: 892 - DNA, 52 bp, Artificial Sequence; identical to SEQ ID NO: 875
  Synthetic: Hsa196_F_ilmn (Illumina)

SEQ ID NO: 893 - DNA, 52 bp, Artificial Sequence
  Synthetic: Hsa197_F_ilmn (Illumina)
cactctttccctacacgacgctcttccgatctcatgtggtccttgtgttcgt

SEQ ID NO: 894 - DNA, 52 bp, Artificial Sequence
  Synthetic: Hsa198_F_ilmn (Illumina)
cactctttccctacacgacgctcttccgatctggtaacagtgaggctgggaa

SEQ ID NO: 895 - DNA, 52 bp, Artificial Sequence
  Synthetic: Hsa199_F_ilmn (Illumina)
cactctttccctacacgacgctcttccgatctggtctgtcctctctgttgcc

SEQ ID NO: 896 - DNA, 52 bp, Artificial Sequence; identical to SEQ ID NO: 836
  Synthetic: Hsa200_F_ilmn (Illumina)

SEQ ID NO: 897 - DNA, 50 bp, Artificial Sequence; identical to SEQ ID NO: 825
  Synthetic: Hsa201_F_ilmn (Illumina)

SEQ ID NO: 898 - DNA, 52 bp, Artificial Sequence
  Synthetic: Hsa202_F_ilmn (Illumina)
cactctttccctacacgacgctcttccgatctcaaggctttgcctacgagtc

SEQ ID NO: 899 - DNA, 52 bp, Artificial Sequence
  Synthetic: Hsa203_F_ilmn (Illumina)
cactctttccctacacgacgctcttccgatctggaaattggcaagtggagtc

SEQ ID NO: 900 - DNA, 52 bp, Artificial Sequence; identical to SEQ ID NO: 836
  Synthetic: Hsa204_F_ilmn (Illumina)

SEQ ID NO: 901 - DNA, 52 bp, Artificial Sequence; identical to SEQ ID NO: 886
  Synthetic: Hsa205_F_ilmn (Illumina)

SEQ ID NO: 902 - DNA, 52 bp, Artificial Sequence; identical to SEQ ID NO: 832
  Synthetic: Hsa206_F_ilmn (Illumina)

SEQ ID NO: 903 - DNA, 52 bp, Artificial Sequence; identical to SEQ ID NO: 836
  Synthetic: Hsa207_F_ilmn (Illumina)

SEQ ID NO: 904 - DNA, 50 bp, Artificial Sequence; identical to SEQ ID NO: 827
  Synthetic: Hsa208_F_ilmn (Illumina)

SEQ ID NO: 905 - DNA, 51 bp, Artificial Sequence; identical to SEQ ID NO: 829
  Synthetic: Hsa209_F_ilmn (Illumina)

SEQ ID NO: 906 - DNA, 52 bp, Artificial Sequence; identical to SEQ ID NO: 894
  Synthetic: Hsa210_F_ilmn (Illumina)

SEQ ID NO: 907 - DNA, 52 bp, Artificial Sequence; identical to SEQ ID NO: 852
  Synthetic: Hsa211_F_ilmn (Illumina)

SEQ ID NO: 908 - DNA, 52 bp, Artificial Sequence; identical to SEQ ID NO: 878
  Synthetic: Hsa212_F_ilmn (Illumina)

SEQ ID NO: 909 - DNA, 52 bp, Artificial Sequence; identical to SEQ ID NO: 865
  Synthetic: Hsa213_F_ilmn (Illumina)

SEQ ID NO: 910 - DNA, 52 bp, Artificial Sequence; identical to SEQ ID NO: 885
  Synthetic: Hsa214_F_ilmn (Illumina)

SEQ ID NO: 911 - DNA, 52 bp, Artificial Sequence; identical to SEQ ID NO: 838
  Synthetic: Hsa215_F_ilmn (Illumina)

SEQ ID NO: 912 - DNA, 52 bp, Artificial Sequence; identical to SEQ ID NO: 894
  Synthetic: Hsa216_F_ilmn (Illumina)

SEQ ID NO: 913 - DNA, 52 bp, Artificial Sequence; identical to SEQ ID NO: 886
  Synthetic: Hsa217_F_ilmn (Illumina)

SEQ ID NO: 914 - DNA, 52 bp, Artificial Sequence; identical to SEQ ID NO: 852
  Synthetic: Hsa218_F_ilmn (Illumina)

SEQ ID NO: 915 - DNA, 52 bp, Artificial Sequence; identical to SEQ ID NO: 836
  Synthetic: Hsa219_F_ilmn (Illumina)

SEQ ID NO: 916 - DNA, 52 bp, Artificial Sequence
  Synthetic: Hsa220_F_ilmn (Illumina)
cactctttccctacacgacgctcttccgatctccgccaggaaggtctacata

SEQ ID NO: 917 - DNA, 52 bp, Artificial Sequence; identical to SEQ ID NO: 893
  Synthetic: Hsa221_F_ilmn (Illumina)

SEQ ID NO: 918 - DNA, 51 bp, Artificial Sequence; identical to SEQ ID NO: 829
  Synthetic: Hsa222_F_ilmn (Illumina)

SEQ ID NO: 919 - DNA, 52 bp, Artificial Sequence; identical to SEQ ID NO: 894
  Synthetic: Hsa223_F_ilmn (Illumina)

SEQ ID NO: 920 - DNA, 52 bp, Artificial Sequence
  Synthetic: Hsa224_F_ilmn (Illumina)
cactctttccctacacgacgctcttccgatctatttcccttctcgctctgct

SEQ ID NO: 921 - DNA, 48 bp, Artificial Sequence
  Synthetic: Hsa129_R_ilmn (Illumina)
ggagttcagacgtgtgctcttccgatctgtggtggcacaaactgacac

SEQ ID NO: 922 - DNA, 48 bp, Artificial Sequence
  Synthetic: Hsa130_R_ilmn (Illumina)
ggagttcagacgtgtgctcttccgatctcaaccagggttgttcctttg

SEQ ID NO: 923 - DNA, 48 bp, Artificial Sequence
  Synthetic: Hsa131_R_ilmn (Illumina)
ggagttcagacgtgtgctcttccgatctgtgtgacttgggccagatgt

SEQ ID NO: 924 - DNA, 48 bp, Artificial Sequence
  Synthetic: Hsa132_R_ilmn (Illumina)
ggagttcagacgtgtgctcttccgatctactcagcaccatctttccgt

SEQ ID NO: 925 - DNA, 48 bp, Artificial Sequence
  Synthetic: Hsa133_R_ilmn (Illumina)
ggagttcagacgtgtgctcttccgatctggcacccagagtgagtgagt

SEQ ID NO: 926 - DNA, 48 bp, Artificial Sequence; identical to SEQ ID NO: 922
  Synthetic: Hsa134_R_ilmn (Illumina)

SEQ ID NO: 927 - DNA, 50 bp, Artificial Sequence
  Synthetic: Hsa135_R_ilmn (Illumina)
ggagttcagacgtgtgctcttccgatctgactacaattcccaattcccaa

SEQ ID NO: 928 - DNA, 48 bp, Artificial Sequence
  Synthetic: Hsa136_R_ilmn (Illumina)
ggagttcagacgtgtgctcttccgatctgaaggcacagttaccggaga

SEQ ID NO: 929 - DNA, 48 bp, Artificial Sequence
  Synthetic: Hsa137_R_ilmn (Illumina)
ggagttcagacgtgtgctcttccgatctagcaatgggcctactaagca

SEQ ID NO: 930 - DNA, 48 bp, Artificial Sequence; identical to SEQ ID NO: 929
  Synthetic: Hsa138_R_ilmn (Illumina)

SEQ ID NO: 931 - DNA, 48 bp, Artificial Sequence
  Synthetic: Hsa139_R_ilmn (Illumina)
ggagttcagacgtgtgctcttccgatctctgtctccagcctctggcta

SEQ ID NO: 932 - DNA, 49 bp, Artificial Sequence
  Synthetic: Hsa140_R_ilmn (Illumina)
ggagttcagacgtgtgctcttccgatctttcattctcttcggaggaaca

SEQ ID NO: 933 - DNA, 47 bp, Artificial Sequence
  Synthetic: Hsa141_R_ilmn (Illumina)
ggagttcagacgtgtgctcttccgatctaccctgccatcctgcttac

SEQ ID NO: 934 - DNA, 48 bp, Artificial Sequence
  Synthetic: Hsa142_R_ilmn (Illumina)
ggagttcagacgtgtgctcttccgatctagcacctttcacactcaccc

SEQ ID NO: 935 - DNA, 48 bp, Artificial Sequence; identical to SEQ ID NO: 928
  Synthetic: Hsa143_R_ilmn (Illumina)

SEQ ID NO: 936 - DNA, 48 bp, Artificial Sequence
  Synthetic: Hsa144_R_ilmn (Illumina)
ggagttcagacgtgtgctcttccgatcttacgagggctcctctgacac

SEQ ID NO: 937 - DNA, 48 bp, Artificial Sequence; identical to SEQ ID NO: 925
  Synthetic: Hsa145_R_ilmn (Illumina)

SEQ ID NO: 938 - DNA, 48 bp, Artificial Sequence
  Synthetic: Hsa146_R_ilmn (Illumina)
ggagttcagacgtgtgctcttccgatctgtttctggctcagttcctgc

SEQ ID NO: 939 - DNA, 50 bp, Artificial Sequence
  Synthetic: Hsa147_R_ilmn (Illumina)
ggagttcagacgtgtgctcttccgatctcaaagacattgaaaccctctgg

SEQ ID NO: 940 - DNA, 49 bp, Artificial Sequence; identical to SEQ ID NO: 932
  Synthetic: Hsa148_R_ilmn (Illumina)

SEQ ID NO: 941 - DNA, 48 bp, Artificial Sequence; identical to SEQ ID NO: 929
  Synthetic: Hsa149_R_ilmn (Illumina)

SEQ ID NO: 942 - DNA, 48 bp, Artificial Sequence; identical to SEQ ID NO: 921
  Synthetic: Hsa150_R_ilmn (Illumina)

SEQ ID NO: 943 - DNA, 48 bp, Artificial Sequence
  Synthetic: Hsa151_R_ilmn (Illumina)
ggagttcagacgtgtgctcttccgatcttttcctcacagaagccaaca

SEQ ID NO: 944 - DNA, 50 bp, Artificial Sequence
  Synthetic: Hsa152_R_ilmn (Illumina)
ggagttcagacgtgtgctcttccgatctccatgaaagctacaaccagtga

SEQ ID NO: 945 - DNA, 46 bp, Artificial Sequence
  Synthetic: Hsa153_R_ilmn (Illumina)
ggagttcagacgtgtgctcttccgatctatccctacacccgcacct

SEQ ID NO: 946 - DNA, 48 bp, Artificial Sequence
  Synthetic: Hsa154_R_ilmn (Illumina)
ggagttcagacgtgtgctcttccgatctgatggagagagaccagcgtc

SEQ ID NO: 947 - DNA, 47 bp, Artificial Sequence
  Synthetic: Hsa155_R_ilmn (Illumina)
ggagttcagacgtgtgctcttccgatctcatggagggctgagagagg

SEQ ID NO: 948 - DNA, 48 bp, Artificial Sequence
  Synthetic: Hsa156_R_ilmn (Illumina)
ggagttcagacgtgtgctcttccgatctcggaatcagaatcggacact

SEQ ID NO: 949 - DNA, 48 bp, Artificial Sequence; identical to SEQ ID NO: 929
  Synthetic: Hsa157_R_ilmn (Illumina)

SEQ ID NO: 950 - DNA, 48 bp, Artificial Sequence
  Synthetic: Hsa158_R_ilmn (Illumina)
ggagttcagacgtgtgctcttccgatcttccagaaagctaagcctcca

SEQ ID NO: 951 - DNA, 48 bp, Artificial Sequence; identical to SEQ ID NO: 922
  Synthetic: Hsa159_R_ilmn (Illumina)

SEQ ID NO: 952 - DNA, 48 bp, Artificial Sequence
  Synthetic: Hsa160_R_ilmn (Illumina)
ggagttcagacgtgtgctcttccgatctccactctgagagagcatccc

SEQ ID NO: 953 - DNA, 48 bp, Artificial Sequence; identical to SEQ ID NO: 921
  Synthetic: Hsa161_R_ilmn (Illumina)

SEQ ID NO: 954 - DNA, 49 bp, Artificial Sequence; identical to SEQ ID NO: 932
  Synthetic: Hsa162_R_ilmn (Illumina)

SEQ ID NO: 955 - DNA, 48 bp, Artificial Sequence
  Synthetic: Hsa163_R_ilmn (Illumina)
ggagttcagacgtgtgctcttccgatctattcccaagtgggctttctt

SEQ ID NO: 956 - DNA, 48 bp, Artificial Sequence
  Synthetic: Hsa164_R_ilmn (Illumina)
ggagttcagacgtgtgctcttccgatcttttcctttcccaacatcctg

SEQ ID NO: 957 - DNA, 48 bp, Artificial Sequence; identical to SEQ ID NO: 922
  Synthetic: Hsa165_R_ilmn (Illumina)

SEQ ID NO: 958 - DNA, 48 bp, Artificial Sequence; identical to SEQ ID NO: 928
  Synthetic: Hsa166_R_ilmn (Illumina)

SEQ ID NO: 959 - DNA, 49 bp, Artificial Sequence
  Synthetic: Hsa167_R_ilmn (Illumina)
ggagttcagacgtgtgctcttccgatctaatactacatgccggaggacc

SEQ ID NO: 960 - DNA, 49 bp, Artificial Sequence
  Synthetic: Hsa168_R_ilmn (Illumina)
ggagttcagacgtgtgctcttccgatctcctgtccacagctcactaggt

SEQ ID NO: 961 - DNA, 47 bp, Artificial Sequence
  Synthetic: Hsa169_R_ilmn (Illumina)
ggagttcagacgtgtgctcttccgatctgtcctggcgaggagaccta

SEQ ID NO: 962 - DNA, 48 bp, Artificial Sequence
  Synthetic: Hsa170_R_ilmn (Illumina)
ggagttcagacgtgtgctcttccgatctcgtgcttacctgtctgtgga

SEQ ID NO: 963 - DNA, 48 bp, Artificial Sequence; identical to SEQ ID NO: 946
  Synthetic: Hsa171_R_ilmn (Illumina)

SEQ ID NO: 964 - DNA, 48 bp, Artificial Sequence; identical to SEQ ID NO: 938
  Synthetic: Hsa172_R_ilmn (Illumina)

SEQ ID NO: 965 - DNA, 48 bp, Artificial Sequence; identical to SEQ ID NO: 929
  Synthetic: Hsa173_R_ilmn (Illumina)

SEQ ID NO: 966 - DNA, 48 bp, Artificial Sequence; identical to SEQ ID NO: 925
  Synthetic: Hsa174_R_ilmn (Illumina)

SEQ ID NO: 967 - DNA, 48 bp, Artificial Sequence; identical to SEQ ID NO: 934
  Synthetic: Hsa175_R_ilmn (Illumina)

SEQ ID NO: 968 - DNA, 48 bp, Artificial Sequence
  Synthetic: Hsa176_R_ilmn (Illumina)
ggagttcagacgtgtgctcttccgatctttggcataaaccactgatgc

SEQ ID NO: 969 - DNA, 48 bp, Artificial Sequence; identical to SEQ ID NO: 921
  Synthetic: Hsa177_R_ilmn (Illumina)

SEQ ID NO: 970 - DNA, 48 bp, Artificial Sequence
  Synthetic: Hsa178_R_ilmn (Illumina)
ggagttcagacgtgtgctcttccgatctgcatttaccaggagcaggaa

SEQ ID NO: 971 - DNA, 48 bp, Artificial Sequence
  Synthetic: Hsa179_R_ilmn (Illumina)
ggagttcagacgtgtgctcttccgatcttaatgtgacggcaatggaga

SEQ ID NO: 972 - DNA, 48 bp, Artificial Sequence
  Synthetic: Hsa180_R_ilmn (Illumina)
ggagttcagacgtgtgctcttccgatctacaggcaggacgttgactct

SEQ ID NO: 973 - DNA, 48 bp, Artificial Sequence; identical to SEQ ID NO: 934
  Synthetic: Hsa181_R_ilmn (Illumina)

SEQ ID NO: 974 - DNA, 48 bp, Artificial Sequence
  Synthetic: Hsa182_R_ilmn (Illumina)
ggagttcagacgtgtgctcttccgatctagggctcaccttgacaatga

SEQ ID NO: 975 - DNA, 49 bp, Artificial Sequence; identical to SEQ ID NO: 932
  Synthetic: Hsa183_R_ilmn (Illumina)

SEQ ID NO: 976 - DNA, 47 bp, Artificial Sequence
  Synthetic: Hsa184_R_ilmn (Illumina)
ggagttcagacgtgtgctcttccgatctgctgagcaggtgtagacgc

SEQ ID NO: 977 - DNA, 48 bp, Artificial Sequence; identical to SEQ ID NO: 921
  Synthetic: Hsa185_R_ilmn (Illumina)

SEQ ID NO: 978 - DNA, 48 bp, Artificial Sequence; identical to SEQ ID NO: 931
  Synthetic: Hsa186_R_ilmn (Illumina)

SEQ ID NO: 979 - DNA, 48 bp, Artificial Sequence; identical to SEQ ID NO: 970
  Synthetic: Hsa187_R_ilmn (Illumina)

SEQ ID NO: 980 - DNA, 48 bp, Artificial Sequence; identical to SEQ ID NO: 928
  Synthetic: Hsa188_R_ilmn (Illumina)

SEQ ID NO: 981 - DNA, 48 bp, Artificial Sequence
  Synthetic: Hsa189_R_ilmn (Illumina)
ggagttcagacgtgtgctcttccgatctatggattcagctcagatggg

SEQ ID NO: 982 - DNA, 48 bp, Artificial Sequence
  Synthetic: Hsa190_R_ilmn (Illumina)
ggagttcagacgtgtgctcttccgatctgaatcaggcctgggtgataa

SEQ ID NO: 983 - DNA, 48 bp, Artificial Sequence; identical to SEQ ID NO: 928
  Synthetic: Hsa191_R_ilmn (Illumina)

SEQ ID NO: 984 - DNA, 48 bp, Artificial Sequence; identical to SEQ ID NO: 952
  Synthetic: Hsa192_R_ilmn (Illumina)

SEQ ID NO: 985 - DNA, 48 bp, Artificial Sequence; identical to SEQ ID NO: 948
  Synthetic: Hsa193_R_ilmn (Illumina)

SEQ ID NO: 986 - DNA, 48 bp, Artificial Sequence; identical to SEQ ID NO: 970
  Synthetic: Hsa194_R_ilmn (Illumina)

SEQ ID NO: 987 - DNA, 50 bp, Artificial Sequence; identical to SEQ ID NO: 944
  Synthetic: Hsa195_R_ilmn (Illumina)

SEQ ID NO: 988 - DNA, 48 bp, Artificial Sequence; identical to SEQ ID NO: 971
  Synthetic: Hsa196_R_ilmn (Illumina)

SEQ ID NO: 989 - DNA, 48 bp, Artificial Sequence; identical to SEQ ID NO: 946
  Synthetic: Hsa197_R_ilmn (Illumina)

SEQ ID NO: 990 - DNA, 48 bp, Artificial Sequence
  Synthetic: Hsa198_R_ilmn (Illumina)
ggagttcagacgtgtgctcttccgatctgcaacagagaggacagaccc

SEQ ID NO: 991 - DNA, 47 bp, Artificial Sequence
  Synthetic: Hsa199_R_ilmn (Illumina)
ggagttcagacgtgtgctcttccgatctgcatcaccctaggcagtca

SEQ ID NO: 992 - DNA, 49 bp, Artificial Sequence; identical to SEQ ID NO: 932
  Synthetic: Hsa200_R_ilmn (Illumina)

SEQ ID NO: 993 - DNA, 48 bp, Artificial Sequence; identical to SEQ ID NO: 921
  Synthetic: Hsa201_R_ilmn (Illumina)

SEQ ID NO: 994 - DNA, 48 bp, Artificial Sequence
  Synthetic: Hsa202_R_ilmn (Illumina)
ggagttcagacgtgtgctcttccgatctgagtgggtacgatgcattcc

SEQ ID NO: 995 - DNA, 48 bp, Artificial Sequence
  Synthetic: Hsa203_R_ilmn (Illumina)
ggagttcagacgtgtgctcttccgatctgggcaattaaagcggttaca

SEQ ID NO: 996 - DNA, 49 bp, Artificial Sequence; identical to SEQ ID NO: 932
  Synthetic: Hsa204_R_ilmn (Illumina)

SEQ ID NO: 997 - DNA, 48 bp, Artificial Sequence; identical to SEQ ID NO: 982
  Synthetic: Hsa205_R_ilmn (Illumina)

SEQ ID NO: 998 - DNA, 48 bp, Artificial Sequence; identical to SEQ ID NO: 928
  Synthetic: Hsa206_R_ilmn (Illumina)

SEQ ID NO: 999 - DNA, 49 bp, Artificial Sequence; identical to SEQ ID NO: 932
  Synthetic: Hsa207_R_ilmn (Illumina)

SEQ ID NO: 1000 - DNA, 48 bp, Artificial Sequence
  Synthetic: Hsa208_R_ilmn (Illumina)
ggagttcagacgtgtgctcttccgatctccctcccaagaccaggttag

SEQ ID NO: 1001 - DNA, 48 bp, Artificial Sequence; identical to SEQ ID NO: 925
  Synthetic: Hsa209_R_ilmn (Illumina)

SEQ ID NO: 1002 - DNA, 48 bp, Artificial Sequence; identical to SEQ ID NO: 990
  Synthetic: Hsa210_R_ilmn (Illumina)

SEQ ID NO: 1003 - DNA, 48 bp, Artificial Sequence; identical to SEQ ID NO: 948
  Synthetic: Hsa211_R_ilmn (Illumina)

SEQ ID NO: 1004 - DNA, 48 bp, Artificial Sequence; identical to SEQ ID NO: 974
  Synthetic: Hsa212_R_ilmn (Illumina)

SEQ ID NO: 1005 - DNA, 48 bp, Artificial Sequence
  Synthetic: Hsa213_R_ilmn (Illumina)
ggagttcagacgtgtgctcttccgatctgaggagacctagaggccgtg

SEQ ID NO: 1006 - DNA, 48 bp, Artificial Sequence; identical to SEQ ID NO: 981
  Synthetic: Hsa214_R_ilmn (Illumina)

SEQ ID NO: 1007 - DNA, 48 bp, Artificial Sequence; identical to SEQ ID NO: 934
  Synthetic: Hsa215_R_ilmn (Illumina)

SEQ ID NO: 1008 - DNA, 48 bp, Artificial Sequence; identical to SEQ ID NO: 990
  Synthetic: Hsa216_R_ilmn (Illumina)

SEQ ID NO: 1009 - DNA, 48 bp, Artificial Sequence; identical to SEQ ID NO: 982
  Synthetic: Hsa217_R_ilmn (Illumina)

SEQ ID NO: 1010 - DNA, 48 bp, Artificial Sequence; identical to SEQ ID NO: 948
  Synthetic: Hsa218_R_ilmn (Illumina)

SEQ ID NO: 1011 - DNA, 49 bp, Artificial Sequence; identical to SEQ ID NO: 932
  Synthetic: Hsa219_R_ilmn (Illumina)

SEQ ID NO: 1012 - DNA, 48 bp, Artificial Sequence
  Synthetic: Hsa220_R_ilmn (Illumina)
ggagttcagacgtgtgctcttccgatctgcggtggatcttgagatagc

SEQ ID NO: 1013 - DNA, 48 bp, Artificial Sequence; identical to SEQ ID NO: 946
  Synthetic: Hsa221_R_ilmn (Illumina)

SEQ ID NO: 1014 - DNA, 48 bp, Artificial Sequence; identical to SEQ ID NO: 925
  Synthetic: Hsa222_R_ilmn (Illumina)

SEQ ID NO: 1015 - DNA, 48 bp, Artificial Sequence; identical to SEQ ID NO: 990
  Synthetic: Hsa223_R_ilmn (Illumina)

SEQ ID NO: 1016 - DNA, 48 bp, Artificial Sequence
  Synthetic: Hsa224_R_ilmn (Illumina)
ggagttcagacgtgtgctcttccgatctctccagtcctgcctatcagc

SEQ ID NO: 1017 - DNA, 97 bp, Artificial Sequence
  Synthetic: Hsa33F
accgagcgtttcctcacgtcacagtatgtctctggcgagttccccgcgccagcggggataaaccgtactaaaaatgtactgacctcctattaatgcc

SEQ ID NO: 1018 - DNA, 97 bp, Artificial Sequence
  Synthetic: Hsa36F
accgcctcattcgctgccaacctagccagcccagaagagttccccgcgccagcggggataaaccgtcgacagccacagacttgtctggcggagtttc

SEQ ID NO: 1019 - DNA, 97 bp, Artificial Sequence
  Synthetic: Hsa37F
accgtctgtggctgtcgacatgctaagtgagggcctgagttccccgcgccagcggggataaaccgtagtctcaagtttgttcaaagctggactcctc

SEQ ID NO: 1020 - DNA, 97 bp, Artificial Sequence
  Synthetic: Hsa38F
accgttggctgttatgaggacttcacagctggtgtcgagttccccgcgccagcggggataaaccgggaggaaggactcctccactggagaactgata

SEQ ID NO: 1021 - DNA, 97 bp, Artificial Sequence
  Synthetic: Hsa39F
accgaggtaatgcgtcggcccgggactacatctcccgagttccccgcgccagcggggataaaccgacggcaactcggttaagtcttcccccaccgcc

SEQ ID NO: 1022 - DNA, 97 bp, Artificial Sequence
  Synthetic: Hsa40F
accgatgcggtagtcgctgcagctagctgcccacctgagttccccgcgccagcggggataaaccggggaggcggggtaagggaagtaggtggaagat

SEQ ID NO: 1023 - DNA, 97 bp, Artificial Sequence
  Synthetic: Hsa42F
accggcaggaggaggtggagagagagtgggggaaaagagttccccgcgccagcggggataaaccgatgaaaaggcagtcaggtcttcagtagccaaa

SEQ ID NO: 1024 - DNA, 97 bp, Artificial Sequence
  Synthetic: Hsa43F
accgatgagtctaggttacattcagtgcaaaaaaccgagttccccgcgccagcggggataaaccggtaagtttttaaaatatatatctaccatgtat

SEQ ID NO: 1025 - DNA, 97 bp, Artificial Sequence
  Synthetic: Hsa44F
accgctttccttggagccaaatttaaaacctctgccgagttccccgcgccagcggggataaaccgctagggcctcggtgatggaaatccacttgtgc

SEQ ID NO: 1026 - DNA, 97 bp, Artificial Sequence
  Synthetic: Hsa45F
accgcatgacggacaagtacaggctgcacctgtcaggagttccccgcgccagcggggataaaccgaccaatccattgcccacaatgccagttaagaa

SEQ ID NO: 1027 - DNA, 97 bp, Artificial Sequence
  Synthetic: Hsa46F
accgacaagttttgggtctcagcgcaggcctcagttgagttccccgcgccagcggggataaaccgaggtctgtccagatgctaagaccaggtacttc

SEQ ID NO: 1028 - DNA, 97 bp, Artificial Sequence
  Synthetic: Hsa47F
accggtaatgtgtggggagcgggcgtcggaaggaccgagttccccgcgccagcggggataaaccgcacgaaggggttgggggatgctgggggtccgg

SEQ ID NO: 1029 - DNA, 97 bp, Artificial Sequence
  Synthetic: Hsa48F
accgcggcggctgagggtgacccagaaccgggtcccgagttccccgcgccagcggggataaaccgaaggccagttgtatggaccgtgtggtggtggt

SEQ ID NO: 1030 - DNA, 97 bp, Artificial Sequence
  Synthetic: Hsa49F
accgtatatctgcaaatttaataaatcaagagggaagagttccccgcgccagcggggataaaccgacaaatcacaaactggtgtgaatagagccagc

SEQ ID NO: 1031 - DNA, 97 bp, Artificial Sequence
  Synthetic: Hsa51F
accgaagactaagaggtagtttctgaacttctccccgagttccccgcgccagcggggataaaccgctgttctattttccagcaagaggctcccgagc

SEQ ID NO: 1032 - DNA, 97 bp, Artificial Sequence
  Synthetic: Hsa52F
accggactgaagaccaagcaacctggaaagaagtcggagttccccgcgccagcggggataaaccgtgtctgcaggagagcaaaacaaacttagccgt

SEQ ID NO: 1033 - DNA, 97 bp, Artificial Sequence
  Synthetic: Hsa53F
accgttggcctctctttggatccaataggcatttttgagttccccgcgccagcggggataaaccgcaggtattgacaaattttatataactttataa

SEQ ID NO: 1034 - DNA, 97 bp, Artificial Sequence
  Synthetic: Hsa56F
accgaaactacaacacctagtacccttggaagtaccgagttccccgcgccagcggggataaaccgttccctgggtaggtaactctggggtagcagta

SEQ ID NO: 1035 - DNA, 97 bp, Artificial Sequence
  Synthetic: Hsa58F
accgggatggcatgggagacaaggtactcctccagggagttccccgcgccagcggggataaaccggccttaacagaaatctcggattctctcctggg

SEQ ID NO: 1036 - DNA, 97 bp, Artificial Sequence
  Synthetic: Hsa59F
accgattggaattatcttctagctcttgtcgaagatgagttccccgcgccagcggggataaaccgaaggtatcaagactgtgacttttaattgtagt

SEQ ID NO: 1037 - DNA, 97 bp, Artificial Sequence
  Synthetic: Hsa60F
accgatgattggaattatcttctagctcttgtcgaagagttccccgcgccagcggggataaaccggtatcaagactgtgacttttaattgtagttta

SEQ ID NO: 1038 - DNA, 97 bp, Artificial Sequence
  Synthetic: Hsa62F
accgggaacagattttgtgcaaaactctgcagaaacgagttccccgcgccagcggggataaaccgcagttccaaggtcagtaaattactgaaaggta

SEQ ID NO: 1039 - DNA, 97 bp, Artificial Sequence
  Synthetic: Hsa63F
accggaatccagcttcttccaatttcttcacatcgtgagttccccgcgccagcggggataaaccggagctaataaatattaagggaattagtgaagc

SEQ ID NO: 1040 - DNA, 97 bp, Artificial Sequence
  Synthetic: Hsa67F
accgccagaggcccggcacccccgcacaggcgcctcgagttccccgcgccagcggggataaaccgaaggagcaattcctcttctgcccgcttggctg

SEQ ID NO: 1041 - DNA, 97 bp, Artificial Sequence
  Synthetic: Hsa68F
accggaagggtcgctctttgcagcttctttgaattcgagttccccgcgccagcggggataaaccgagctgatgtcaatgctatggactgcacaaaag

SEQ ID NO: 1042 - DNA, 97 bp, Artificial Sequence
  Synthetic: Hsa69F
accgaacaaaatcctctatgtctgtagacaactcttgagttccccgcgccagcggggataaaccgcaaggtaagccagcgactgctagatttttttt

SEQ ID NO: 1043 - DNA, 97 bp, Artificial Sequence
  Synthetic: Hsa72F
accgccagtggcactggggggtgccgcctcggggcagagttccccgcgccagcggggataaaccggccaggcccaggcgactggcggccaggtgtcc

SEQ ID NO: 1044 - DNA, 97 bp, Artificial Sequence
  Synthetic: Hsa74F
accgggctacagaaaccgtgccaaaagacttctacagagttccccgcgccagcggggataaaccgttcaggagagttattttccttttttgcaaaat

SEQ ID NO: 1045 - DNA, 97 bp, Artificial Sequence
  Synthetic: Hsa77F
accggatttcctaaaggaatttaacaacaagaccatgagttccccgcgccagcggggataaaccggttcctctgtctgatggacttattcaatgttt

SEQ ID NO: 1046 - DNA, 97 bp, Artificial Sequence
  Synthetic: Hsa78F
accgacggtggaaacgttctctactacgaagtgatggagttccccgcgccagcggggataaaccgaaatcagtaacatggaagtctcaaatatttca

SEQ ID NO: 1047 - DNA, 97 bp, Artificial Sequence
  Synthetic: Hsa82F
accgaattatgagatatggaaacagacgcatttttagagttccccgcgccagcggggataaaccgtgccaccaggtaaatatcaatttatttctttt

SEQ ID NO: 1048 - DNA, 97 bp, Artificial Sequence
  Synthetic: Hsa84F
accgtctttttaactctctcctgtagaatcttacatgagttccccgcgccagcggggataaaccgaagatatacaaaaagaaacagtttattgctta

SEQ ID NO: 1049 - DNA, 97 bp, Artificial Sequence
  Synthetic: Hsa87F
accggcttctctgattttggtaggctagaaatacgtgagttccccgcgccagcggggataaaccgaagagcagcatcttgaatctcatacagactgc

SEQ ID NO: 1050 - DNA, 97 bp, Artificial Sequence
  Synthetic: Hsa88F
accgatgctgctcttcatctctcttatttaccactggagttccccgcgccagcggggataaaccgcaggcaatatctggaacttctccagtggcttc

SEQ ID NO: 1051 - DNA, 97 bp, Artificial Sequence
  Synthetic: Hsa89F
accgtttttccaaatcctgttaaagtataaaacagagagttccccgcgccagcggggataaaccgaccacattggaaagtcaatgccaaatgtccta

SEQ ID NO: 1052 - DNA, 97 bp, Artificial Sequence
  Synthetic: Hsa92F
accggcagcagtcagtgggcagtggccccttgcagcgagttccccgcgccagcggggataaaccgcactctgactgcctggtatgtgcctctgcttt

SEQ ID NO: 1053 - DNA, 97 bp, Artificial Sequence; identical to SEQ ID NO: 657
  Synthetic: Hsa94F

SEQ ID NO: 1054 - DNA, 97 bp, Artificial Sequence
  Synthetic: Hsa96F
accgcaaacaccgcatctgggagaggaaagcagaaggagttccccgcgccagcggggataaaccgccctgttgatgcaggacactcgccgcaggctc

SEQ ID NO: 1055 - DNA, 97 bp, Artificial Sequence
  Synthetic: Hsa97F
accgccctgcccactactctcttaatgctgacaacagagttccccgcgccagcggggataaaccgcagaggtgggagcagtgcccattgctggaagc

SEQ ID NO: 1056 - DNA, 97 bp, Artificial Sequence
  Synthetic: Hsa98F
accgtgcttccagcaatgggcactgctcccacctctgagttccccgcgccagcggggataaaccgacgaggatgtccatcacataatccaaatggcc

SEQ ID NO: 1057 - DNA, 97 bp, Artificial Sequence
  Synthetic: Hsa99F
accgactgctcagggctatcctctcagagtgacattgagttccccgcgccagcggggataaaccgctgcttcaccttaaataacaaaaacagaggtt

SEQ ID NO: 1058 - DNA, 97 bp, Artificial Sequence
  Synthetic: Hsa100F
accggacaaagttggttcttcagaatcattctgtgagagttccccgcgccagcggggataaaccgttctagaaatgaaacatgttctaataatacag

SEQ ID NO: 1059 - DNA, 97 bp, Artificial Sequence
  Synthetic: Hsa101F
accgagctagttaaggacaaagttggttcttcagaagagttccccgcgccagcggggataaaccgaaacatgttctaataatacagtaatctctcag

SEQ ID NO: 1060 - DNA, 97 bp, Artificial Sequence
  Synthetic: Hsa103F
accgaaaacccaatagagtaggttctttgatcttttgagttccccgcgccagcggggataaaccggaatctttggacaaagtgaaaaacctttttga

SEQ ID NO: 1061 - DNA, 97 bp, Artificial Sequence
  Synthetic: Hsa104F
accgattcctttgcaattttaacttttttcccgctagagttccccgcgccagcggggataaaccgagcaaggtactagtgaaatcaccagttttagc

SEQ ID NO: 1062 - DNA, 97 bp, Artificial Sequence
  Synthetic: Hsa105F
accgttttgagattttcagtttgtctacataaattagagttccccgcgccagcggggataaaccgaaaatgtagaaaaagaaacagcaaaaagtcct

SEQ ID NO: 1063 - DNA, 97 bp, Artificial Sequence
  Synthetic: Hsa106F
accgtctgactcacagaagtttttctactacaacttgagttccccgcgccagcggggataaaccggaatatttgatggtcaaccagaaagaataaat

SEQ ID NO: 1064 - DNA, 97 bp, Artificial Sequence
  Synthetic: Hsa107F
accgcagatgaatttaccacattatatgaaaagcctgagttccccgcgccagcggggataaaccgtttccattttagaaagttccttacacaaagtt

SEQ ID NO: 1065 - DNA, 97 bp, Artificial Sequence
  Synthetic: Hsa108F
accgtttcagttttaccaatttccatttttacgtttgagttccccgcgccagcggggataaaccgtttgttctacttactccaaagattcagaaaac

SEQ ID NO: 1066 - DNA, 97 bp, Artificial Sequence
  Synthetic: Hsa109F
accgtgtggcatgacttggcagtttagaatctgtcagagttccccgcgccagcggggataaaccggttttgtcaaattcaagaattggaaaaagaag

SEQ ID NO: 1067 - DNA, 97 bp, Artificial Sequence
  Synthetic: Hsa112F
accgttatgcaattcttctggtttctgatcaaagaagagttccccgcgccagcggggataaaccgaaagaacaaaatggacattctaagttatgagg

SEQ ID NO: 1068 - DNA, 97 bp, Artificial Sequence
  Synthetic: Hsa120F
accggaatgatttccacagaggtgaggccaggggccgagttccccgcgccagcggggataaaccgccatggacttctatgatccagcaaggtaggtt

SEQ ID NO: 1069 - DNA, 97 bp, Artificial Sequence
  Synthetic: Hsa122F
accgaagaatcttctctgaacctacaagagaggaaagagttccccgcgccagcggggataaaccgagatgatgaggtgagttggcagcaggtctttg

SEQ ID NO: 1070 - DNA, 97 bp, Artificial Sequence
  Synthetic: Hsa123F
accgtgacgggctattaccgggtgaactacgacgaagagttccccgcgccagcggggataaaccgtgctgaagagatcgttctgggctgtggagagg

SEQ ID NO: 1071 - DNA, 97 bp, Artificial Sequence
  Synthetic: Hsa124F
accgtctaagtcatccaaagcatgaatcagggaggagagttccccgcgccagcggggataaaccgagctaatcctcaagtcggcgtggcttttcctc

SEQ ID NO: 1072 - DNA, 97 bp, Artificial Sequence
  Synthetic: Hsa126F
accgtcttagaccccagccacagggatatttccctggagttccccgcgccagcggggataaaccgttccttcgtcatccttgtaatccatcagggtc

SEQ ID NO: 1073 - DNA, 97 bp, Artificial Sequence
  Synthetic: Hsa128F
accggtaaatatgagggaaatgtctttctatgaagagagttccccgcgccagcggggataaaccgctgtgttctcatgtcaaaaacatggaactttc

SEQ ID NO: 1074 - DNA, 97 bp, Artificial Sequence
  Synthetic: Hsa33R
actcggcattaataggaggtcagtacatttttagtacggtttatccccgctggcgcggggaactcgccagagacatactgtgacgtgaggaaacgct

SEQ ID NO: 1075 - DNA, 97 bp, Artificial Sequence
  Synthetic: Hsa36R
actcgaaactccgccagacaagtctgtggctgtcgacggtttatccccgctggcgcggggaactcttctgggctggctaggttggcagcgaatgagg

SEQ ID NO: 1076 - DNA, 97 bp, Artificial Sequence
  Synthetic: Hsa37R
actcgaggagtccagctttgaacaaacttgagactacggtttatccccgctggcgcggggaactcaggccctcacttagcatgtcgacagccacaga

SEQ ID NO: 1077 - DNA, 97 bp, Artificial Sequence
  Synthetic: Hsa38R
actctatcagttctccagtggaggagtccttcctcccggtttatccccgctggcgcggggaactcgacaccagctgtgaagtcctcataacagccaa

SEQ ID NO: 1078 - DNA, 97 bp, Artificial Sequence
  Synthetic: Hsa39R
actcggcggtgggggaagacttaaccgagttgccgtcggtttatccccgctggcgcggggaactcgggagatgtagtcccgggccgacgcattacct

SEQ ID NO: 1079 - DNA, 97 bp, Artificial Sequence
  Synthetic: Hsa40R
actcatcttccacctacttcccttaccccgcctccccggtttatccccgctggcgcggggaactcaggtgggcagctagctgcagcgactaccgcat

SEQ ID NO: 1080 - DNA, 97 bp, Artificial Sequence
  Synthetic: Hsa42R
actctttggctactgaagacctgactgccttttcatcggtttatccccgctggcgcggggaactcttttcccccactctctctccacctcctcctgc

SEQ ID NO: 1081 - DNA, 97 bp, Artificial Sequence
  Synthetic: Hsa43R
actcatacatggtagatatatattttaaaaacttaccggtttatccccgctggcgcggggaactcggttttttgcactgaatgtaacctagactcat

SEQ ID NO: 1082 - DNA, 97 bp, Artificial Sequence
  Synthetic: Hsa44R
actcgcacaagtggatttccatcaccgaggccctagcggtttatccccgctggcgcggggaactcggcagaggttttaaatttggctccaaggaaag

SEQ ID NO: 1083 - DNA, 97 bp, Artificial Sequence
  Synthetic: Hsa45R
actcttcttaactggcattgtgggcaatggattggtcggtttatccccgctggcgcggggaactcctgacaggtgcagcctgtacttgtccgtcatg

SEQ ID NO: 1084 - DNA, 97 bp, Artificial Sequence
  Synthetic: Hsa46R
actcgaagtacctggtcttagcatctggacagacctcggtttatccccgctggcgcggggaactcaactgaggcctgcgctgagacccaaaacttgt

SEQ ID NO: 1085 - DNA, 97 bp, Artificial Sequence
  Synthetic: Hsa47R
actcccggacccccagcatcccccaaccccttcgtgcggtttatccccgctggcgcggggaactcggtccttccgacgcccgctccccacacattac

SEQ ID NO: 1086 - DNA, 97 bp, Artificial Sequence
  Synthetic: Hsa48R
actcaccaccaccacacggtccatacaactggccttcggtttatccccgctggcgcggggaactcgggacccggttctgggtcaccctcagccgccg

SEQ ID NO: 1087 - DNA, 97 bp, Artificial Sequence
  Synthetic: Hsa49R
actcgctggctctattcacaccagtttgtgatttgtcggtttatccccgctggcgcggggaactcttccctcttgatttattaaatttgcagatata

SEQ ID NO: 1088 - DNA, 97 bp, Artificial Sequence
  Synthetic: Hsa51R
actcgctcgggagcctcttgctggaaaatagaacagcggtttatccccgctggcgcggggaactcggggagaagttcagaaactacctcttagtctt

SEQ ID NO: 1089 - DNA, 97 bp, Artificial Sequence
  Synthetic: Hsa52R
actcacggctaagtttgttttgctctcctgcagacacggtttatccccgctggcgcggggaactccgacttctttccaggttgcttggtcttcagtc

SEQ ID NO: 1090 - DNA, 97 bp, Artificial Sequence
  Synthetic: Hsa53R
actcttataaagttatataaaatttgtcaatacctgcggtttatccccgctggcgcggggaactcaaaaatgcctattggatccaaagagaggccaa

SEQ ID NO: 1091 - DNA, 97 bp, Artificial Sequence
  Synthetic: Hsa56R
actctactgctaccccagagttacctacccagggaacggtttatccccgctggcgcggggaactcggtacttccaagggtactaggtgttgtagttt

SEQ ID NO: 1092 - DNA, 97 bp, Artificial Sequence
  Synthetic: Hsa58R
actccccaggagagaatccgagatttctgttaaggccggtttatccccgctggcgcggggaactccctggaggagtaccttgtctcccatgccatcc

SEQ ID NO: 1093 - DNA, 97 bp, Artificial Sequence
  Synthetic: Hsa59R
actcactacaattaaaagtcacagtcttgataccttcggtttatccccgctggcgcggggaactcatcttcgacaagagctagaagataattccaat

SEQ ID NO: 1094 - DNA, 97 bp, Artificial Sequence
  Synthetic: Hsa60R
actctaaactacaattaaaagtcacagtcttgataccggtttatccccgctggcgcggggaactcttcgacaagagctagaagataattccaatcat

SEQ ID NO: 1095 - DNA, 97 bp, Artificial Sequence
  Synthetic: Hsa62R
actctacctttcagtaatttactgaccttggaactgcggtttatccccgctggcgcggggaactcgtttctgcagagttttgcacaaaatctgttcc

SEQ ID NO: 1096 - DNA, 97 bp, Artificial Sequence
  Synthetic: Hsa63R
actcgcttcactaattcccttaatatttattagctccggtttatccccgctggcgcggggaactcacgatgtgaagaaattggaagaagctggattc

SEQ ID NO: 1097 - DNA, 97 bp, Artificial Sequence
  Synthetic: Hsa67R
actccagccaagcgggcagaagaggaattgctccttcggtttatccccgctggcgcggggaactcgaggcgcctgtgcgggggtgccgggcctctgg

SEQ ID NO: 1098 - DNA, 97 bp, Artificial Sequence
  Synthetic: Hsa68R
actccttttgtgcagtccatagcattgacatcagctcggtttatccccgctggcgcggggaactcgaattcaaagaagctgcaaagagcgacccttc

SEQ ID NO: 1099 - DNA, 97 bp, Artificial Sequence
  Synthetic: Hsa69R
actcaaaaaaaatctagcagtcgctggcttaccttgcggtttatccccgctggcgcggggaactcaagagttgtctacagacatagaggattttgtt

SEQ ID NO: 1100 - DNA, 97 bp, Artificial Sequence
  Synthetic: Hsa72R
actcggacacctggccgccagtcgcctgggcctggccggtttatccccgctggcgcggggaactctgccccgaggcggcaccccccagtgccactgg

SEQ ID NO: 1101 - DNA, 97 bp, Artificial Sequence
  Synthetic: Hsa74R
actcattttgcaaaaaaggaaaataactctcctgaacggtttatccccgctggcgcggggaactctgtagaagtcttttggcacggtttctgtagcc

SEQ ID NO: 1102 - DNA, 97 bp, Artificial Sequence
  Synthetic: Hsa77R
actcaaacattgaataagtccatcagacagaggaaccggtttatccccgctggcgcggggaactcatggtcttgttgttaaattcctttaggaaatc

SEQ ID NO: 1103 - DNA, 97 bp, Artificial Sequence
  Synthetic: Hsa78R
actctgaaatatttgagacttccatgttactgatttcggtttatccccgctggcgcggggaactccatcacttcgtagtagagaacgtttccaccgt

SEQ ID NO: 1104 - DNA, 97 bp, Artificial Sequence
  Synthetic: Hsa82R
actcaaaagaaataaattgatatttacctggtggcacggtttatccccgctggcgcggggaactctaaaaatgcgtctgtttccatatctcataatt

SEQ ID NO: 1105 - DNA, 97 bp, Artificial Sequence
  Synthetic: Hsa84R
actctaagcaataaactgtttctttttgtatatcttcggtttatccccgctggcgcggggaactcatgtaagattctacaggagagagttaaaaaga

SEQ ID NO: 1106 - DNA, 97 bp, Artificial Sequence
  Synthetic: Hsa87R
actcgcagtctgtatgagattcaagatgctgctcttcggtttatccccgctggcgcggggaactcacgtatttctagcctaccaaaatcagagaagc

SEQ ID NO: 1107 - DNA, 97 bp, Artificial Sequence
  Synthetic: Hsa88R
actcgaagccactggagaagttccagatattgcctgcggtttatccccgctggcgcggggaactccagtggtaaataagagagatgaagagcagcat

SEQ ID NO: 1108 - DNA, 97 bp, Artificial Sequence
  Synthetic: Hsa89R
actctaggacatttggcattgactttccaatgtggtcggtttatccccgctggcgcggggaactctctgttttatactttaacaggatttggaaaaa

SEQ ID NO: 1109 - DNA, 97 bp, Artificial Sequence
  Synthetic: Hsa92R
actcaaagcagaggcacataccaggcagtcagagtgcggtttatccccgctggcgcggggaactcgctgcaaggggccactgcccactgactgctgc

SEQ ID NO: 1110 - DNA, 97 bp, Artificial Sequence; identical to SEQ ID NO: 753
  Synthetic: Hsa94R

SEQ ID NO: 1111 - DNA, 97 bp, Artificial Sequence
  Synthetic: Hsa96R
actcgagcctgcggcgagtgtcctgcatcaacagggcggtttatccccgctggcgcggggaactccttctgctttcctctcccagatgcggtgtttg

SEQ ID NO: 1112 - DNA, 97 bp, Artificial Sequence
  Synthetic: Hsa97R
actcgcttccagcaatgggcactgctcccacctctgcggtttatccccgctggcgcggggaactctgttgtcagcattaagagagtagtgggcaggg

SEQ ID NO: 1113 - DNA, 97 bp, Artificial Sequence
  Synthetic: Hsa98R
actcggccatttggattatgtgatggacatcctcgtcggtttatccccgctggcgcggggaactcagaggtgggagcagtgcccattgctggaagca

SEQ ID NO: 1114 - DNA, 97 bp, Artificial Sequence
  Synthetic: Hsa99R
actcaacctctgtttttgttatttaaggtgaagcagcggtttatccccgctggcgcggggaactcaatgtcactctgagaggatagccctgagcagt

SEQ ID NO: 1115 - DNA, 97 bp, Artificial Sequence
  Synthetic: Hsa100R
actcctgtattattagaacatgtttcatttctagaacggtttatccccgctggcgcggggaactctcacagaatgattctgaagaaccaactttgtc

SEQ ID NO: 1116 - DNA, 97 bp, Artificial Sequence
  Synthetic: Hsa101R
actcctgagagattactgtattattagaacatgtttcggtttatccccgctggcgcggggaactcttctgaagaaccaactttgtccttaactagct

SEQ ID NO: 1117 - DNA, 97 bp, Artificial Sequence
  Synthetic: Hsa103R
actctcaaaaaggtttttcactttgtccaaagattccggtttatccccgctggcgcggggaactcaaaagatcaaagaacctactctattgggtttt

SEQ ID NO: 1118 - DNA, 97 bp, Artificial Sequence
  Synthetic: Hsa104R
actcgctaaaactggtgatttcactagtaccttgctcggtttatccccgctggcgcggggaactctagcgggaaaaaagttaaaattgcaaaggaat

SEQ ID NO: 1119 - DNA, 97 bp, Artificial Sequence
  Synthetic: Hsa105R
actcaggactttttgctgtttctttttctacattttcggtttatccccgctggcgcggggaactctaatttatgtagacaaactgaaaatctcaaaa

SEQ ID NO: 1120 - DNA, 97 bp, Artificial Sequence
  Synthetic: Hsa106R
actcatttattctttctggttgaccatcaaatattccggtttatccccgctggcgcggggaactcaagttgtagtagaaaaacttctgtgagtcaga

SEQ ID NO: 1121 - DNA, 97 bp, Artificial Sequence
  Synthetic: Hsa107R
actcaactttgtgtaaggaactttctaaaatggaaacggtttatccccgctggcgcggggaactcaggcttttcatataatgtggtaaattcatctg

SEQ ID NO: 1122 - DNA, 97 bp, Artificial Sequence
  Synthetic: Hsa108R
actcgttttctgaatctttggagtaagtagaacaaacggtttatccccgctggcgcggggaactcaaacgtaaaaatggaaattggtaaaactgaaa

SEQ ID NO: 1123 - DNA, 97 bp, Artificial Sequence
  Synthetic: Hsa109R
actccttctttttccaattcttgaatttgacaaaaccggtttatccccgctggcgcggggaactctgacagattctaaactgccaagtcatgccaca

SEQ ID NO: 1124 - DNA, 97 bp, Artificial Sequence
  Synthetic: Hsa112R
actccctcataacttagaatgtccattttgttctttcggtttatccccgctggcgcggggaactcttctttgatcagaaaccagaagaattgcataa

SEQ ID NO: 1125 - DNA, 97 bp, Artificial Sequence
  Synthetic: Hsa120R
actcaacctaccttgctggatcatagaagtccatggcggtttatccccgctggcgcggggaactcggcccctggcctcacctctgtggaaatcattc

SEQ ID NO: 1126 - DNA, 97 bp, Artificial Sequence
  Synthetic: Hsa122R
actccaaagacctgctgccaactcacctcatcatctcggtttatccccgctggcgcggggaactctttcctctcttgtaggttcagagaagattctt

SEQ ID NO: 1127 - DNA, 97 bp, Artificial Sequence
  Synthetic: Hsa123R
actccctctccacagcccagaacgatctcttcagcacggtttatccccgctggcgcggggaactcttcgtcgtagttcacccggtaatagcccgtca

SEQ ID NO: 1128 - DNA, 97 bp, Artificial Sequence
  Synthetic: Hsa124R
actcgaggaaaagccacgccgacttgaggattagctcggtttatccccgctggcgcggggaactctcctccctgattcatgctttggatgacttaga

SEQ ID NO: 1129 - DNA, 97 bp, Artificial Sequence
  Synthetic: Hsa126R
actcgaccctgatggattacaaggatgacgaaggaacggtttatccccgctggcgcggggaactccagggaaatatccctgtggctggggtctaaga

SEQ ID NO: 1130 - DNA, 97 bp, Artificial Sequence
  Synthetic: Hsa128R
actcgaaagttccatgtttttgacatgagaacacagcggtttatccccgctggcgcggggaactctcttcatagaaagacatttccctcatatttac

SEQ ID NO: 1131 - DNA, 51 bp, Artificial Sequence
  Synthetic: Hsa33F_ilmn (Illumina)
cactctttccctacacgacgctcttccgatctccagtcatgaacgtctccg

SEQ ID NO: 1132 - DNA, 50 bp, Artificial Sequence
  Synthetic: Hsa36F_ilmn (Illumina)
cactctttccctacacgacgctcttccgatctgaagagccctgccgagag

SEQ ID NO: 1133 - DNA, 52 bp, Artificial Sequence
  Synthetic: Hsa37F_ilmn (Illumina)
cactctttccctacacgacgctcttccgatctctaggttggcagcgaatgag

SEQ ID NO: 1134 - DNA, 52 bp, Artificial Sequence
  Synthetic: Hsa38F_ilmn (Illumina)
cactctttccctacacgacgctcttccgatctcagcctatgagcttcctggt

SEQ ID NO: 1135 - DNA, 52 bp, Artificial Sequence
  Synthetic: Hsa39F_ilmn (Illumina)
cactctttccctacacgacgctcttccgatctaatagtccagctgcgatggt

SEQ ID NO: 1136 - DNA, 52 bp, Artificial Sequence
  Synthetic: Hsa40F_ilmn (Illumina)
cactctttccctacacgacgctcttccgatctcgcaagtttccttctctgga

SEQ ID NO: 1137 - DNA, 50 bp, Artificial Sequence
  Synthetic: Hsa42F_ilmn (Illumina)
cactctttccctacacgacgctcttccgatctcttcagcactgcagccac

SEQ ID NO: 1138 - DNA, 52 bp, Artificial Sequence
  Synthetic: Hsa43F_ilmn (Illumina)
cactctttccctacacgacgctcttccgatctccactgtttcatgtggcatc

SEQ ID NO: 1139 - DNA, 52 bp, Artificial Sequence
  Synthetic: Hsa44F_ilmn (Illumina)
cactctttccctacacgacgctcttccgatctgatgaatgtccacctcgctt

SEQ ID NO: 1140 - DNA, 52 bp, Artificial Sequence
  Synthetic: Hsa45F_ilmn (Illumina)
cactctttccctacacgacgctcttccgatcttcccaaagtaccagtttgcc

SEQ ID NO: 1141 - DNA, 52 bp, Artificial Sequence
  Synthetic: Hsa46F_ilmn (Illumina)
cactctttccctacacgacgctcttccgatcttttggacacacgaaggcata

SEQ ID NO: 1142 - DNA, 52 bp, Artificial Sequence
  Synthetic: Hsa47F_ilmn (Illumina)
cactctttccctacacgacgctcttccgatctctcagccatctccttctcgt

SEQ ID NO: 1143 - DNA, 51 bp, Artificial Sequence
  Synthetic: Hsa48F_ilmn (Illumina)
cactctttccctacacgacgctcttccgatctagtgccgctatggggacct

SEQ ID NO: 1144 - DNA, 59 bp, Artificial Sequence
  Synthetic: Hsa49F_ilmn (Illumina)
cactctttccctacacgacgctcttccgatctcacctttattcctttgtctaacaatct

SEQ ID NO: 1145 - DNA, 52 bp, Artificial Sequence
  Synthetic: Hsa51F_ilmn (Illumina)
cactctttccctacacgacgctcttccgatctagactcttgggatgacgcac

SEQ ID NO: 1146 - DNA, 52 bp, Artificial Sequence
  Synthetic: Hsa52F_ilmn (Illumina)
cactctttccctacacgacgctcttccgatctcaagctctggtaggcagctc

SEQ ID NO: 1147 - DNA, 53 bp, Artificial Sequence
  Synthetic: Hsa53F_ilmn (Illumina)
cactctttccctacacgacgctcttccgatctaatgcatccctgtgtaagtgc

SEQ ID NO: 1148 - DNA, 52 bp, Artificial Sequence
  Synthetic: Hsa56F_ilmn (Illumina)
cactctttccctacacgacgctcttccgatctccatgttgagacacagggtg

SEQ ID NO: 1149 - DNA, 52 bp, Artificial Sequence
  Synthetic: Hsa58F_ilmn (Illumina)
cactctttccctacacgacgctcttccgatctaggtctctctggtgctggaa

SEQ ID NO: 1150 - DNA, 52 bp, Artificial Sequence
  Synthetic: Hsa59F_ilmn (Illumina)
cactctttccctacacgacgctcttccgatcttgaggcactgaagatggaga

SEQ ID NO: 1151 - DNA, 52 bp, Artificial Sequence; identical to SEQ ID NO: 1150
  Synthetic: Hsa60F_ilmn (Illumina)

SEQ ID NO: 1152 - DNA, 55 bp, Artificial Sequence
  Synthetic: Hsa62F_ilmn (Illumina)
cactctttccctacacgacgctcttccgatcttttgccctgaattccttacatac

SEQ ID NO: 1153 - DNA, 52 bp, Artificial Sequence
  Synthetic: Hsa63F_ilmn (Illumina)
cactctttccctacacgacgctcttccgatctcttcatttgcagcagtgtgg

SEQ ID NO: 1154 - DNA, 52 bp, Artificial Sequence
  Synthetic: Hsa67F_ilmn (Illumina)
cactctttccctacacgacgctcttccgatctcccaactcacctcatcacct

SEQ ID NO: 1155 - DNA, 52 bp, Artificial Sequence
  Synthetic: Hsa68F_ilmn (Illumina)
cactctttccctacacgacgctcttccgatctaaatgaatgaggatggcctg

SEQ ID NO: 1156 - DNA, 52 bp, Artificial Sequence
  Synthetic: Hsa69F_ilmn (Illumina)
cactctttccctacacgacgctcttccgatctggcttgctttcagtttggag

SEQ ID NO: 1157 - DNA, 52 bp, Artificial Sequence
  Synthetic: Hsa72F_ilmn (Illumina)
cactctttccctacacgacgctcttccgatctcctgacttgggtacgtgctt

SEQ ID NO: 1158 - DNA, 52 bp, Artificial Sequence
  Synthetic: Hsa74F_ilmn (Illumina)
cactctttccctacacgacgctcttccgatctcaaggaaggattttcgggtt

SEQ ID NO: 1159 - DNA, 50 bp, Artificial Sequence
  Synthetic: Hsa77F_ilmn (Illumina)
cactctttccctacacgacgctcttccgatcttcaggtcatgcgtggaca

SEQ ID NO: 1160 - DNA, 52 bp, Artificial Sequence
  Synthetic: Hsa78F_ilmn (Illumina)
cactctttccctacacgacgctcttccgatctcatacgctatgtgacacggg

SEQ ID NO: 1161 - DNA, 52 bp, Artificial Sequence
  Synthetic: Hsa82F_ilmn (Illumina)
cactctttccctacacgacgctcttccgatctgcacaaacaatgaggtgcat

SEQ ID NO: 1162 - DNA, 56 bp, Artificial Sequence
  Synthetic: Hsa84F_ilmn (Illumina)
cactctttccctacacgacgctcttccgatctcaattggaatcctaactttccttg

SEQ ID NO: 1163 - DNA, 54 bp, Artificial Sequence
  Synthetic: Hsa87F_ilmn (Illumina)
cactctttccctacacgacgctcttccgatcttgcatatttcttcatgtgacca

SEQ ID NO: 1164 - DNA, 54 bp, Artificial Sequence
  Synthetic: Hsa88F_ilmn (Illumina)
cactctttccctacacgacgctcttccgatctctttgccacgtatttctagcct

SEQ ID NO: 1165 - DNA, 60 bp, Artificial Sequence
  Synthetic: Hsa89F_ilmn (Illumina)
cactctttccctacacgacgctcttccgatctttctatgagaaaggttgtgagaataata

SEQ ID NO: 1166 - DNA, 51 bp, Artificial Sequence
  Synthetic: Hsa92F_ilmn (Illumina)
cactctttccctacacgacgctcttccgatctagtgacgcgcactgtctgt

SEQ ID NO: 1167 - DNA, 50 bp, Artificial Sequence; identical to SEQ ID NO: 825
  Synthetic: Hsa94F_ilmn (Illumina)

SEQ ID NO: 1168 - DNA, 53 bp, Artificial Sequence
  Synthetic: Hsa96F_ilmn (Illumina)
cactctttccctacacgacgctcttccgatctccagtggataatgaatgcaca

SEQ ID NO: 1169 - DNA, 52 bp, Artificial Sequence
  Synthetic: Hsa97F_ilmn (Illumina)
cactctttccctacacgacgctcttccgatcttagcttgctttggagggaaa

SEQ ID NO: 1170 - DNA, 52 bp, Artificial Sequence
  Synthetic: Hsa98F_ilmn (Illumina)
cactctttccctacacgacgctcttccgatctaagagagtagtgggcagggc

SEQ ID NO: 1171 - DNA, 52 bp, Artificial Sequence
  Synthetic: Hsa99F_ilmn (Illumina)
cactctttccctacacgacgctcttccgatctaatgcaaaggacaccacaca

SEQ ID NO: 1172 - DNA, 56 bp, Artificial Sequence
  Synthetic: Hsa100F_ilmn (Illumina)
cactctttccctacacgacgctcttccgatctggtttattgcattcttctgtgaaa

SEQ ID NO: 1173 - DNA, 56 bp, Artificial Sequence; identical to SEQ ID NO: 1172
  Synthetic: Hsa101F_ilmn (Illumina)

SEQ ID NO: 1174 - DNA, 52 bp, Artificial Sequence
  Synthetic: Hsa103F_ilmn (Illumina)
cactctttccctacacgacgctcttccgatctagtgaccttccagggacaac

SEQ ID NO: 1175 - DNA, 52 bp, Artificial Sequence; identical to SEQ ID NO: 1174
  Synthetic: Hsa104F_ilmn (Illumina)

SEQ ID NO: 1176 - DNA, 52 bp, Artificial Sequence
  Synthetic: Hsa105F_ilmn (Illumina)
cactctttccctacacgacgctcttccgatcttgtggtgccacctaagctct

SEQ ID NO: 1177 - DNA, 54 bp, Artificial Sequence
  Synthetic: Hsa106F_ilmn (Illumina)
cactctttccctacacgacgctcttccgatctttcagtcattgaaaattcagcc

SEQ ID NO: 1178 - DNA, 52 bp, Artificial Sequence
  Synthetic: Hsa107F_ilmn (Illumina)
cactctttccctacacgacgctcttccgatctcgaacattcagaccagctca

SEQ ID NO: 1179 - DNA, 57 bp, Artificial Sequence
  Synthetic: Hsa108F_ilmn (Illumina)
cactctttccctacacgacgctcttccgatctagtgtcacttgttgagaacattcat

SEQ ID NO: 1180 - DNA, 57 bp, Artificial Sequence
  Synthetic: Hsa109F_ilmn (Illumina)
cactctttccctacacgacgctcttccgatcttttgaaacagaagcagtagaaattg

SEQ ID NO: 1181 - DNA, 56 bp, Artificial Sequence
  Synthetic: Hsa112F_ilmn (Illumina)
cactctttccctacacgacgctcttccgatctttagtgtcgccaaagagtcattta

SEQ ID NO: 1182 - DNA, 52 bp, Artificial Sequence
  Synthetic: Hsa120F_ilmn (Illumina)
cactctttccctacacgacgctcttccgatctcccatcctgaaaccaagaag

SEQ ID NO: 1183 - DNA, 52 bp, Artificial Sequence
  Synthetic: Hsa122F_ilmn (Illumina)
cactctttccctacacgacgctcttccgatcttggaatttcttggcaatgtg

SEQ ID NO: 1184 - DNA, 51 bp, Artificial Sequence
  Synthetic: Hsa123F_ilmn (Illumina)
cactctttccctacacgacgctcttccgatctcaccgagtggtctctctgc

SEQ ID NO: 1185 - DNA, 53 bp, Artificial Sequence
  Synthetic: Hsa124F_ilmn (Illumina)
cactctttccctacacgacgctcttccgatcttccatctttcttaccaggcag

SEQ ID NO: 1186 - DNA, 52 bp, Artificial Sequence
  Synthetic: Hsa126F_ilmn (Illumina)
cactctttccctacacgacgctcttccgatctcaagggttcttctcaaccca

SEQ ID NO: 1187 - DNA, 52 bp, Artificial Sequence
  Synthetic: Hsa128F_ilmn (Illumina)
cactctttccctacacgacgctcttccgatctcctggaagaaaccttggtga

SEQ ID NO: 1188 - DNA, 48 bp, Artificial Sequence
  Synthetic: Hsa33R_ilmn (Illumina)
ggagttcagacgtgtgctcttccgatctaaggcccagaattcagcata

SEQ ID NO: 1189 - DNA, 48 bp, Artificial Sequence
  Synthetic: Hsa36R_ilmn (Illumina)
ggagttcagacgtgtgctcttccgatctacttaagtgggcaccaggag

SEQ ID NO: 1190 - DNA, 48 bp, Artificial Sequence
  Synthetic: Hsa37R_ilmn (Illumina)
ggagttcagacgtgtgctcttccgatctgacaaatctccagctgctcc

SEQ ID NO: 1191 - DNA, 48 bp, Artificial Sequence
  Synthetic: Hsa38R_ilmn (Illumina)
ggagttcagacgtgtgctcttccgatctatagcagtttccatggtgcc

SEQ ID NO: 1192 - DNA, 48 bp, Artificial Sequence
  Synthetic: Hsa39R_ilmn (Illumina)
ggagttcagacgtgtgctcttccgatctgcgagagtatcgtctgagcc

SEQ ID NO: 1193 - DNA, 48 bp, Artificial Sequence
  Synthetic: Hsa40R_ilmn (Illumina)
ggagttcagacgtgtgctcttccgatctttctggaaagctcctcggta

SEQ ID NO: 1194 - DNA, 50 bp, Artificial Sequence
  Synthetic: Hsa42R_ilmn (Illumina)
ggagttcagacgtgtgctcttccgatcttgtccactgaagtaggtgcaaa

SEQ ID NO: 1195 - DNA, 48 bp, Artificial Sequence
  Synthetic: Hsa43R_ilmn (Illumina)
ggagttcagacgtgtgctcttccgatctttggtaaaagggcaacaatg

SEQ ID NO: 1196 - DNA, 48 bp, Artificial Sequence
  Synthetic: Hsa44R_ilmn (Illumina)
ggagttcagacgtgtgctcttccgatctattgggatcagcatcgactc

SEQ ID NO: 1197 - DNA, 48 bp, Artificial Sequence
  Synthetic: Hsa45R_ilmn (Illumina)
ggagttcagacgtgtgctcttccgatctctgcccaccatctactccat

SEQ ID NO: 1198 - DNA, 48 bp, Artificial Sequence
  Synthetic: Hsa46R_ilmn (Illumina)
ggagttcagacgtgtgctcttccgatctctaactgccctggagacctg

SEQ ID NO: 1199 - DNA, 46 bp, Artificial Sequence
  Synthetic: Hsa47R_ilmn (Illumina)
ggagttcagacgtgtgctcttccgatctctccctcccaccttctcc

SEQ ID NO: 1200 - DNA, 47 bp, Artificial Sequence
  Synthetic: Hsa48R_ilmn (Illumina)
ggagttcagacgtgtgctcttccgatctgtagccgtagggggctaca

SEQ ID NO: 1201 - DNA, 47 bp, Artificial Sequence
  Synthetic: Hsa49R_ilmn (Illumina)
ggagttcagacgtgtgctcttccgatctgaccctgccacttacatgc

SEQ ID NO: 1202 - DNA, 48 bp, Artificial Sequence
  Synthetic: Hsa51R_ilmn (Illumina)
ggagttcagacgtgtgctcttccgatctcaactctgactgggtcacca

SEQ ID NO: 1203 - DNA, 48 bp, Artificial Sequence
  Synthetic: Hsa52R_ilmn (Illumina)
ggagttcagacgtgtgctcttccgatcttgcttcccaagagtttgctt

SEQ ID NO: 1204 - DNA, 50 bp, Artificial Sequence
  Synthetic: Hsa53R_ilmn (Illumina)
ggagttcagacgtgtgctcttccgatctggttctaagcaacactgtgacg

SEQ ID NO: 1205 - DNA, 48 bp, Artificial Sequence
  Synthetic: Hsa56R_ilmn (Illumina)
ggagttcagacgtgtgctcttccgatctttcttcctcctcgtttccct

SEQ ID NO: 1206 - DNA, 48 bp, Artificial Sequence
  Synthetic: Hsa58R_ilmn (Illumina)
ggagttcagacgtgtgctcttccgatctgcttagccacctcagcaatc

SEQ ID NO: 1207 - DNA, 54 bp, Artificial Sequence
  Synthetic: Hsa59R_ilmn (Illumina)
ggagttcagacgtgtgctcttccgatcttcaagtttacaagagggaatactgaa

SEQ ID NO: 1208 - DNA, 54 bp, Artificial Sequence; identical to SEQ ID NO: 1207
  Synthetic: Hsa60R_ilmn (Illumina)

SEQ ID NO: 1209 - DNA, 49 bp, Artificial Sequence
  Synthetic: Hsa62R_ilmn (Illumina)
ggagttcagacgtgtgctcttccgatctccattctactcatccacagcc

SEQ ID NO: 1210 - DNA, 48 bp, Artificial Sequence
  Synthetic: Hsa63R_ilmn (Illumina)
ggagttcagacgtgtgctcttccgatctattcccactaatgcctccct

SEQ ID NO: 1211 - DNA, 48 bp, Artificial Sequence
  Synthetic: Hsa67R_ilmn (Illumina)
ggagttcagacgtgtgctcttccgatcttgagtcctacctcgtgcctc

SEQ ID NO: 1212 - DNA, 48 bp, Artificial Sequence
  Synthetic: Hsa68R_ilmn (Illumina)
ggagttcagacgtgtgctcttccgatctgctgcagactgaatggaaca

SEQ ID NO: 1213 - DNA, 48 bp, Artificial Sequence
  Synthetic: Hsa69R_ilmn (Illumina)
ggagttcagacgtgtgctcttccgatcttctagcctgggcaacagagt

SEQ ID NO: 1214 - DNA, 48 bp, Artificial Sequence
  Synthetic: Hsa72R_ilmn (Illumina)
ggagttcagacgtgtgctcttccgatctcacgaggagaaccctgagag

SEQ ID NO: 1215 - DNA, 50 bp, Artificial Sequence
  Synthetic: Hsa74R_ilmn (Illumina)
ggagttcagacgtgtgctcttccgatctgggtttctcttggtttctttga

SEQ ID NO: 1216 - DNA, 48 bp, Artificial Sequence
  Synthetic: Hsa77R_ilmn (Illumina)
ggagttcagacgtgtgctcttccgatctttggcaacatgtggattcat

SEQ ID NO: 1217 - DNA, 49 bp, Artificial Sequence
  Synthetic: Hsa78R_ilmn (Illumina)
ggagttcagacgtgtgctcttccgatcttggctaccttggaaactttga

SEQ ID NO: 1218 - DNA, 48 bp, Artificial Sequence
  Synthetic: Hsa82R_ilmn (Illumina)
ggagttcagacgtgtgctcttccgatctagccctgttctctcaccaga

SEQ ID NO: 1219 - DNA, 54 bp, Artificial Sequence
  Synthetic: Hsa84R_ilmn (Illumina)
ggagttcagacgtgtgctcttccgatctaaacttcagtttcatcatcatcattt

SEQ ID NO: 1220 - DNA, 48 bp, Artificial Sequence
  Synthetic: Hsa87R_ilmn (Illumina)
ggagttcagacgtgtgctcttccgatctttgcctgctttactgcaaga

SEQ ID NO: 1221 - DNA, 52 bp, Artificial Sequence
  Synthetic: Hsa88R_ilmn (Illumina)
ggagttcagacgtgtgctcttccgatctttgcattgaaagtctctttaggtg

SEQ ID NO: 1222 - DNA, 56 bp, Artificial Sequence
  Synthetic: Hsa89R_ilmn (Illumina)
ggagttcagacgtgtgctcttccgatcttcttcttcagaggtatctacaactgttt

SEQ ID NO: 1223 - DNA, 48 bp, Artificial Sequence
  Synthetic: Hsa92R_ilmn (Illumina)
ggagttcagacgtgtgctcttccgatcttggctttcactgtgctgttt

SEQ ID NO: 1224 - DNA, 48 bp, Artificial Sequence; identical to SEQ ID NO: 921
  Synthetic: Hsa94R_ilmn (Illumina)

SEQ ID NO: 1225 - DNA, 48 bp, Artificial Sequence
  Synthetic: Hsa96R_ilmn (Illumina)
ggagttcagacgtgtgctcttccgatcttgtagtaggaggaccgggtg

SEQ ID NO: 1226 - DNA, 48 bp, Artificial Sequence
  Synthetic: Hsa97R_ilmn (Illumina)
ggagttcagacgtgtgctcttccgatctctcgacagtcagggtggaat

SEQ ID NO: 1227 - DNA, 48 bp, Artificial Sequence
  Synthetic: Hsa98R_ilmn (Illumina)
ggagttcagacgtgtgctcttccgatcttctactggacggactggagc

SEQ ID NO: 1228 - DNA, 48 bp, Artificial Sequence
  Synthetic: Hsa99R_ilmn (Illumina)
ggagttcagacgtgtgctcttccgatctaatccagtcctgccaatgag

SEQ ID NO: 1229 - DNA, 49 bp, Artificial Sequence
  Synthetic: Hsa100R_ilmn (Illumina)
ggagttcagacgtgtgctcttccgatctggcatgacagagaatcagctt

SEQ ID NO: 1230 - DNA, 49 bp, Artificial Sequence; identical to SEQ ID NO: 1229
  Synthetic: Hsa101R_ilmn (Illumina)

SEQ ID NO: 1231 - DNA, 48 bp, Artificial Sequence
  Synthetic: Hsa103R_ilmn (Illumina)
ggagttcagacgtgtgctcttccgatcttttagggtctttgcccattg

SEQ ID NO: 1232 - DNA, 48 bp, Artificial Sequence; identical to SEQ ID NO: 1231
  Synthetic: Hsa104R_ilmn (Illumina)

SEQ ID NO: 1233 - DNA, 54 bp, Artificial Sequence
  Synthetic: Hsa105R_ilmn (Illumina)
ggagttcagacgtgtgctcttccgatcttcaagtaatgaagtctgactcacaga

SEQ ID NO: 1234 - DNA, 56 bp, Artificial Sequence
  Synthetic: Hsa106R_ilmn (Illumina)
ggagttcagacgtgtgctcttccgatcttgtcattttcagctatagtactgtttga

SEQ ID NO: 1235 - DNA, 53 bp, Artificial Sequence
  Synthetic: Hsa107R_ilmn (Illumina)
ggagttcagacgtgtgctcttccgatctaatcaaattcctctaacactccctt

SEQ ID NO: 1236 - DNA, 48 bp, Artificial Sequence
  Synthetic: Hsa108R_ilmn (Illumina)
ggagttcagacgtgtgctcttccgatctgaatgtgtggcatgacttgg

SEQ ID NO: 1237 - DNA, 48 bp, Artificial Sequence
  Synthetic: Hsa109R_ilmn (Illumina)
ggagttcagacgtgtgctcttccgatctttggcaacacgaaaggtaaa

SEQ ID NO: 1238 - DNA, 48 bp, Artificial Sequence
  Synthetic: Hsa112R_ilmn (Illumina)
ggagttcagacgtgtgctcttccgatctgttgtccctggaaggtcact

SEQ ID NO: 1239 - DNA, 48 bp, Artificial Sequence
  Synthetic: Hsa120R_ilmn (Illumina)
ggagttcagacgtgtgctcttccgatctcccaaattctgcctcatcat

SEQ ID NO: 1240 - DNA, 51 bp, Artificial Sequence
  Synthetic: Hsa122R_ilmn (Illumina)
ggagttcagacgtgtgctcttccgatctcccaaacaacttgctttcataga

SEQ ID NO: 1241 - DNA, 47 bp, Artificial Sequence
  Synthetic: Hsa123R_ilmn (Illumina)
ggagttcagacgtgtgctcttccgatctagcttgagggtgaggtggt

SEQ ID NO: 1242 - DNA, 52 bp, Artificial Sequence
  Synthetic: Hsa124R_ilmn (Illumina)
ggagttcagacgtgtgctcttccgatctcattaacagctgagaaacactgct

SEQ ID NO: 1243 - DNA, 48 bp, Artificial Sequence
  Synthetic: Hsa126R_ilmn (Illumina)
ggagttcagacgtgtgctcttccgatctgagaggcacgagaacacaca

SEQ ID NO: 1244 - DNA, 50 bp, Artificial Sequence
  Synthetic: Hsa128R_ilmn (Illumina)
ggagttcagacgtgtgctcttccgatctcaggtgtgtagcttggagtttg

SEQ ID NO: 1245 - DNA, 5610 bp, Oceanicola sp. HL-35
atgggccccaagaagaagagaaaggtaggctccggcatgaccacatttctgcagttccacgtgctgaccacatatcccccttctaaccctaatagggacgatcagggccggccaaagcaggcaaacctgggaggagcaccaaggctgcggctgagctcccagtctatcaagagggcaatgagggagagccctgcattccagcagggcctggatggacacatcggcacacggaccaagagactgggcgaggagatcagggaggagctggcaaagagggagggcgtgagcaccgatcaggccctggacgtggcatctaaggtggcagccatcttcagcaagctggaggcccccggcaaggacaaggtgcagaagcctctgaccacaaccctggcctttgtgagcccagatgagtgggcactggcaagagacctggcatccaggatgctggcaggagaggagatgcccaaggataaggagctgaagcgcctggtgctgcggagagcagatggagcagtggacatcgcaatgttcggaaggatgctggcagacgagccaggatataacagggaggcagcagtgcaggtgagccacgcaatcacaacccacagagccatcgccgaggacgattggtactctgccgtggacgatctgaataagagggaggatagcggcgcaggacacctgggagagcacggatttggctccggcgtgtactatctgtacgcctgcgtgaacgtggatctgctggtggagaatctggcaggcgaccgcgccctggcagcaaggggcctggaggccctggcaaaggccctggcaacagcaaccccaagaggcaagcagaactctcacgcccaccaccccagggcaatctatgtgagggcagagaggggaccacagcagcctagggacctgaccggcgccttcttttctgccgtggatctgaagagcaatgacatcgagcggacatccatcatcgccctggagagaaccgccgagcagatcgatagggcatacggagcagcatgcgacgatacagccgtgatggacgtgaaggagggaaacggcaccctggcagagatcgcagccttcagcggcgcatctgtgagcgccaatgcaggctccggcgagggaaggggctctctgctgacatgtggcgatgtggaggagaaccctggacctccgaaaaaaaagcggaaagtgggctctggcatgagcgacaggaagcaggtcatcggcacatggtggagaaccaggatcggcgccagaaactccaccgcagcaagggccctggcagcacggctgaatagaggagagggagtggatgtgctggcagagagggccgtgtttgagctgggaagggacctgggcttcctgaagcagccaaagcgcctggtgctgctggtgcgggtgctggcagccgtgagggaggataggggaggcgccctgcctctgaggctgggccagggcgaccctccacccctgagcccactgcggtttcagagactgctgagggcagaaggagaggagctgacaaccctgctgaggcgcgccctgccaatggtgacacgcacctgcgacgtgggcgccctgggagcagacctgctggattggtccgactctacacgcgcaagatgggcctttgcctatttcggcgccacccctccagccagaatcaacaatagcaggccaacacccgagacccccgccctgtccgatcaggagacagaggagggcagcggcgagggaagaggctccctgctgacctgtggcgacgtggaggagaaccctggacctccaaagaagaaaagaaaagtcggctccggcatggcactgtggcctcggtctctgccattcctggcccggagatacctgccaatgcgggagcacctggtgtttacactggccgccgccgtggcctccatgggagagctggcaggacacgagaggaggggcacctggtcttggcccggcagatctagcgtgctgggcctgtgcgcagccgccctgggcatccggcgggacggcgatttctccgccctggacggactgggactggcagtggccgtgtttgatacaggagagccactgagggacttccacaccgccgtgtccatcccatcctctgtggccaagaggccacagtctcgggcagatgccctgcgcatcgacgcaggccggagcaactccacaatcaccctgcgcgattacagggtgggcgtgctgtatggagtggccctgtggggcgacggactgcctaccgtggccgagaatctggtggaggccctgcagcgcccaacattcaccctgtacctgggccggaagagctgtccactggcagcaccactggcaccccgcgtgctgacagccccagatgcagcagccgccctgacagacggaatgaccctgccaccatggagagcaggagcaagggcaggccagatcgcaaccgaggaggagctgcctgcaccaagaacagagaccagacacgataggccaacagacaggaccgcctggcactttgcaccaagggccgtgcggctggtgccttgcgatatcgccccaagaacagcaggacaggtggcagcaggctctggcgagggcaggggcagcctgctgacttgcggcgacgtggaagaaaaccctggacctcctaaaaagaaacgaaaggtaggctccggcatgacactgtggctgagccgggtgcggatcgcaagaggagcagacctggataccctgaggccactgctggaccccagcgccctgcacccagcagcaatggaccccaagatgctgggctcccagacagacgcccaccacagactgatctggaccctgtttgccgattccagagacaggcgccgggacttcctgtggagggcagagggcgccggcaagtttacactgctgagcctgagaccccctaccgcctccagggtgtttgaggcccctgaggtgaaggccttcagcccagatctgctgccaggcgacaggctggccttcgccctgcgggccaacgccacccgcgatcgggccggctccgccaagggcagaagggtggacgtggtcatgcacgccctgcacaatgtgccacccgaggatagggcagcagcaaggatgacactggcacaggatgcagcaagcgactggctgaccggacagggagccagagcaggattcgtgcccgaggaggtgacagcaggcgactactccgtggccgccctgccttctcacaccggccggagaaagggccagccacagtatggcatcctggatctgacaggcgtgctgagagtgaccgaccctgcagcctttctggcaaggctgggacagggatttggaagagcaaggggattcggatgcggactgatgctgatcagaagggcaggcagcggcgaaggcaggggctccctgctgacttgtggcgacgtggaagaaaaccctggacctcccaagaaaaagaggaaagtgggtggcagccagctggtgaagtccgagctggaggagaagaagtccgagctgcgccacaagctgaagtacgtgccccacgagtatatcgagctgatcgagatcgccagaaatcctacccaggatagaatcctggagatgaaagtgatggagttctttatgaaggtgtacggctatcgcggcgagcacctgggaggctctcggaagccagacggagccatctacacagtgggcagccctatcgattatggcgtgatcgtggacaccaaggcctacagcggcggctataatctgcccatcggccaggccgacgagatgcagagatacgtggaggagaaccagacaaggaataagcacatcaacccaaatgagtggtggaaggtgtatcccagctccgtgaccgagttcaagtttctgttcgtgtctggccacttcaagggcaactacaaggcccagctgacacggctgaatcacatcaccaactgcaatggagccgtgctgagcgtggaggagctgctgatcggcggcgagatgatcaaggcaggcacactgaccctggaggaggtgcgccggaagtttaacaatggcgagatcaacttctctgctagcgagacacctggcacctccgagtctgccaccccagagtccggcggctctggctctagcggcggctctggctcctccggaggaatgacagtgagcctgaatctgatcaccgatcgctggattcccgtgctggacacaaccggaacacggcacaccatcgcaccttgggagatggccgacagctcctttgtggccccagattggcccagacctgacctgaacaccgcctgtctggagctgctgatcggactggtgcgcctggccgatccccctgcacaccccgacgattgggaggacaggcaggcccctgacgcagataggctgagggatagactggcaccttttgccccagccttcaatctgctgggcgacggcccacgcttcatgcaggagatgggaggactggtgggcgatgtgcgggcaacagacgtgctgtttatcgattccggcggcgacggaggcgccctgaccgtgagagagggcaggtacccaaacctggacctgccaacagcagcaatggcactgtatgcaatgcagacccaggcacctagcggcggaagaggaaatctgacatccctgaggggaggaggaccaatgaccgtgctggtggaccccggaggaggaatgtggcctctgatctgggcaaacgtgcccgacggcaagccagtggtgcctaatgtgctgccttggatgagaaggacagtgaccagcgagaccggcgtgaggttctttccacaccagggcgatgccgccgaggtgttctttggaatgccacgccggctgtggctggaggcacgcaacgactccgtgacaggcgtgatccagcggccctctggcaccaagtatgtgggctggcgccacccactgacaccctactataggcagaaggcaggcgataccccactgcccgtgaggcctagggcaggcgtgttcggatacaggcactggctgggaatcgcagcagagcagggctctgacctgagggagagaccagcaaccgtggaggcctgggagagccgcggactgggcagaagggccgatatcatcgtggccggctgggccatggagaatatgaaggcaagggactatatctggtcccgggcacctctggtgacactgccagaggagagagccgcctttctgagggatatgatcgaggccgccgacctgctgtctgccgccctgaggggcgccctggccaccctgctgggcgagggcgagggcagagaggccgccagggaggccttttacgtgagaacacaggccgccttcgagggctgggtgagctgtctggataccatcgccctggacgcagcagcaaggggatggctggccgatatgcggaaggtggccctggagatcttcgaggtgctggccctgccaggactggcagacagaaccatcctggtgcagcaggagatcgtggcagcacacaggggactgacaggcagcttctccggctacggcaagctgggcaccaaggcctttggcgtgctgaacctgcctgtgccaacacggaagaaggaggccgccacctga

SEQ ID NO: 1246 - DNA, 5736 bp, Pseudomonas sp. S-6-2
atgggccccaagaagaagagaaaggtaggctccggcatgacacgctttgtgcagctgcacctgctgacctcttatccccctgccaacctgaatagggacgatctgggaaaccctaagacagcaaggctgggaggagtggagagactgagggtgagctcccagtctctgaagcgcgcctggcggacaagcgagctgtttcagcagcagctggcaggaaccatcggaaccagaacaaagaggctgggcatcgaggtgttcgaggccctgctgggagcaggagtgaccgagaagcaggcaagggagtgggcaggacagatcgcaaaggtgtacggagccgccaagaaggataaccccctggagatcgagcagctggtgcacatcgcccctgaggagagggccagcctggaccagctggtggccacactggcagcagagaagagaggaccaaccgacgaggagctggatgccctgctgcaccaccagacagccgtggacatcgccatgtttggcaggatgctggccagcaagacccagttcaatggagaggcagcagtgcaggtggcacacgcaatcggagtgcacgcctccgccatcgaggacgattacttcaccgccgtggacgatctgaaccgcaatgatccaggagcagcacacatcggagagtccggctttgccgccgccgtgttctaccagtatatctgcatcgaccgggatctgctgaagagaaacctgggcggcgacgaggtgctgacacagaaggccctgcgcgccctgaccgaggccgccctgaaggtcggccccagcggcaagcagaattcctttgcctctagggcctttgcccacttcgccctggccgagaagggcacagatcagccacgctccctgtctctggccttcgtgaagccagtggcaggaaccgactacgcaggcgatgccgtggccgccctgcagcaggtgagggacaacatggataaggtgtatggcgtgtgcgccgagtcccgctgtcagtttaatgtgctgacaggagagggctctgtggcagacctgctggatttcgtggcagcagagggctccggcgagggaaggggctctctgctgacctgcggcgacgtggaggagaaccctggacctccgaaaaaaaagcggaaagtgggctccggcatgaagccaaggaagcctcggctgaatgaggcccagcagagatgggtgagggattggtggagggccctgcagccaagggcagagggcgacgagccaatccctggagagctgagcgtgatgggaaggggagagagggcacagctgcggagatgtaccgacgccgatgagctgctgacacagtccgccaccctgctgctggcacacaggctggtggccctgaacggagagagaggaccactgcccgataatagcctgtcctatgagaggatggcatgggtggcaggcgtgctggcaaacgtgaaggacgatctgagagatggcaagtccctggccacccacctgggacaggcagcagacgcagagaggcctccaatgtctgagctgcgctttcgggccatgcagagaggcacagccatgcaggagctgttcctgcactggaggcgcgccctgcagctggcaggaggcaagaccgacgtggcacacctggcagacgatctgctgagctggcagatcgagcagggacagtctgccgcacaggccagcaatggcgtgaagtttcactgggcctacgactactatctgtctgccagagatagggccgccgccaaggagccagagttcaacaaggagatcagcaaaggctccggcgaaggaaggggcagcctgctgacatgcggcgatgtggaggagaaccctggacctccaaagaagaaaagaaaagtcggcagcggcatgaccgactacctgctgctgaggctgtatggaccactggcatcctggggagagatcgcagtgggagagtctaggcacagcgccgtgcagccttctcgcagcgccctgctgggactgctgggagccgccctgggcatcgagagacacgacgatgcagcacagcaggccctggtggatggataccggttcgccatcaagctggagtgtatcggctctcccctgagagactatcacaccgtgcaagtgggagtgccaccaaggaagttccagtttagaagccggagacaggagctggcagcagacaaggtggatacaatcctgtccaccagagagtataggtgcgattctctggccctggtggcagtggaggccctgccaggagcacccgtggacctggccagcctggcagaggccctgcgcaagccaaggtttgccctgtacctgggaaggaagagctgtccactggccctgcctctgtccccaaagatcctggccgcctctagcgtgcgcgaggtgttcgataacctggagctgccttctctgctgggcctgctggacaggtaccagcctgagcaggcctggccaagcagacaggatcagcaggccctgaggccaggagtggcaaggtactattgggaggacggaatgacagcaggaatggcaccttcttttgaggcccagaggcacgatcagccactgagcaggcgccggtggcagttcgcaccaagaagggagtgggtggccctgaacgatggaggacagtccggctctggcgagggaaggggctccctgctgacttgtggcgacgtggaggagaaccctggacctcctaaaaagaaacgaaaggtaggctccggcatgtctcactacttcagcctggtgaggctgatcggctcccctaggcacgacgcctggctgagggatctgagcagacacggagaggcctacagggaccacgccctgatctggagactgttccctggcgacggagcagcaagggatttcgtgtttcgccggctggaggatgagaagtccttttatgtggtgtctgccaggccacctcaggcagacgcaggactgttccacatccagtccaaggcctactctccagagctggcagagggcgactgggtgaggttcgatctgcgcgccaaccccacagtgtctgtgagaagggagaatggcagaagccagaggcacgatgtgctgatgcacgccaagcagctggccagcaccgagaagtccgccctgcccgagcggctggaggcagcaggaagagagtggctgaaggacagggcagagcggtggggcctggacctgagaaccgattccctgatgcagaacggctacagacagcagaggctgaagcgcaagggcaagcacatcgccttttctacactggactatcagggcatcgcccaggtgaccgatcccgagcagctgcgccgggccctgctggacggagtgggacactccaagggattcggatgcggactgctgctggtgaagcgggtggatggcagcggcgagggaagaggctccctgctgacatgtggcgacgtggaagaaaaccctggacctcccaagaaaaagaggaaagtgggtggcagccagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctctgctagcgagacacctggcacctccgagtctgccaccccagagtccggcggctctggctctagcggcggctctggctcctccggaggaatggacctgctgtctgatacatggctgcagtgcaggcacagggacggcaccctgaagcctatcgccatcggccagatcggcctggaggactgtctggagctggtggcacctcggcccgacttccggggcgccctgtaccagttcctgatcggcctgctgcagacagcctatgccccagaggacctgcaggagtggagagatagatacgccaaccctccaaccgccgacgatctggccgaggtgtttgccccttatagggatgccttccagctggagaactccggcccaacattcatgcaggacctgaccctgccagacgatgtgaatcagctgcccgtgctggagctgctgatcgacgcaggctcctctagcaaccagtactttaataagccagcagtggagcacggaatgtgcgagggctgtttcacacaggccctgctgaccatgcagctgaatgcaccatccggcggaaggggcatcagaacatctctgaggggaggaggacctctgaccacactgctggtgccagccgagcagaacgccaccctgtggcagaagctgtggctgaatgtgctgcccctggacgccctggatcacccacctatcaagatgctgtctgatgtgctgccatggctggcaccaacccggacaagcgacgataagcagggccaggacacaccacccgagtctgtgcacccactgcaggcctactggagcatgcctaggcggatcagactggacgcagccaccctggaccagggcgattgcgccgtgtgcggagcacagaacgtgaagcgcatccggcactacagaacaaggcacggcggcaccaattataccggcacatggacccaccccctgaccccttattctctggatagcaagggcgagaagcctccactgagcatcaagggccggcaggcaggaaggggatacagggactggctgggactggtgctgggaaacgaggaccaccagcctgatgccgcccaggtggtgaggcacttcacagccaagctgggcaagccatccgtgcgcctgtggtgctttggcttcgacatgagcaatatgaaggccctgtgctggtacgattccctgctgccagtgcacggagtggcccctgacgtgcagaggaagtttacccgcagcgtgaagcaggtgctggactctgccaacgatatggccagcgtgctgcacaagcaggtgaaggccgcctggttcagaaggcccggcgacgcaggacaggagcctgcagtgacacagtctttttggcagggcagcgagaccgccttctatcaggtgctggagcagctgtccaagctggactttgattctgccgcagagctggcagcaatctacagagcatggctgcaggcaacccgccggctggtgctgagcctgttcgatcactgggtgctgtccggccctctggaggacatggatatgcagcgggtggtgaaggcaagagcagacctggccaaggagctgaacacaggcaaggcccagaagccactgtggaccatcgtgaatcagcacctgaaggagcaggcctga

SEQ ID NO: 1247 - DNA, 5709 bp, Salmonella enterica subsp. enterica serovar Muenster strain
atgggccccaagaagaagagaaaggtaggctctggcatgatcatgaccaccttcatccagctgcacctgctgaccgcatacgcacctgccaacctgaatagagacgagagcggcaggccaaagacagccttcatgggaggagtggagcggctgagagtgagctcccagagcctgaagagagcctggagggtgtccgagacctttgaggccgccatggatggcttcatgggcaagagaacacggagaatcggcgtggactacgtgtataggcctatgaaggatgccggcatcgaggagaagatcgccaagtctagctccgagctgatcgccaagcagttcggcaagctgaagagcgacaaggatgccaagccagagaagaacctggagatcgagcagatcgtgcacgtgagcaatcacgagatctccctgatcaagcagctggtggacaccctgatcgccgataagagggagccaaacgacgaggaggtggagctgctgcgcaaggagcagcggtccgtggatatggccctgtttggccgcatgctggcctctagccccgagttcaatgtggaggcagcatgccaggtgtctcacgccctgggcgtgagcgccgtgaccgtggagtccgacttctttacagccgtggacgatctgaacaataaggaggaggatgcaggctccggccacatgggagagcagggatttgcctctgccctgttctacacctacgtgtgcatcagccgcgacctgctggtggagaacctgggaggcaatgaggagctggccaagcggacaatcgccgccctgaccgagacagccctgaccgtgagccctacaggcaagcagaacagctttgcctcccgcgcatacgcaacctatgccctggcagaagtgggacagaagcagccacgctccctggcagcagccttctttcagcccgtgcgggacaccgatcagatccctgccgccatcacacgcctgaagcagcagcgggcctcttttgacaacgtgtacggcaattgcgccgacgattatagggagctgaacgtgcaggagggaaccggctccctggcagagctgctggccttcgtgtctcagggcagcggcgagggaagaggctctctgctgacatgcggcgatgtggaggagaaccctggacctccgaaaaaaaagcggaaagtgggctctggcatgctgaacagcaataccgccgtgctgtgcagaatcctgcaccctgacgcccagaaggccctgctggattggttcgccacactgagcgagcggtacgagcggaaggacggcaagcgcgtgaacggaagagcatggagggcagagctgaagaggatggcaccaccctacggcgtgatgatctgtgagggacacgacgccctgagacaggccctgctgaagcacatgaggctgcagcctctggatgagatggcactggccctgttcgtgagcgtggcagtgcacatcaagtctcacaaggccaacatcagcttcgccgcacagctgggagagaagctgaagggctccaccccatgcgtgtctgtgctgcgctttgagcggctgcagaaggccagcgaccccgagaccttctgtcagctgctgatccaggccgtgaagatcaggggcacagagggcgtgaatgtgctgtccctggccgatggcatcttcctgtggatggaggagtggcagaggcgcgagaaccaccagccagagtttcgcaaccccttcgagaggaatcgcatccggtgggccaatgagtacctgtctaccagccgcggcaagggctccggcgagggaaggggctctctgctgacctgtggcgacgtggaggagaaccctggacctccaaagaagaaaagaaaagtcggctctggcatgaaggagtacctggtgtttcagctgtatgcacctctggcaagctggggagaggaggcctccggcgagatcagacactctgccaccgtgccaacaaggtccgccctgctgggactgctggcagccgccctgggcatccggcgggatgaggaggccagactgaacaatttcaataggcactaccacctggcagtgcacgccctggcatcccaggacagatggctgagggattatcacaccgtgtctgccccccgcgagaacaagaagaatcggtactataccaggagggacgagctgacactggcccctgatgaagtgggcacactgatctctcagcgcgagtaccggtgcgacggctattggcacgtggcaatcagcgccacccccgatgcacctcactccctgtctgagctgcgggaggccctgctgacaccacacttccccctgtacctgggcagaaagagctgtccactggccctgcctctggcagcaaggctgatgaccggcacactgaaggaggtgtttacccacgcagtggaggagatcagcgccgcagagctgtccggcttcacactgagagagggcatctgctattgggacgatcctgacgaggagtccctggtgtggcagcagaagcagcacagcaacaatcagccagtgtccagacagaggtggcagtttggcggctacaccaggttcaacggaccactgcaggagaggacaggctctggcgagggaaggggcagcctgctgacctgtggcgatgtggaagaaaaccctggacctcctaaaaagaaacgaaaggtaggctctggcatgtatctgagcagaatccagctgaggtttaacaatctgagacccgagatgctggccaagtggaactccgccaggccttacgcctctcaccagtggctgtggcagctgttccctgagcaggagctgagacagttcctgtttagggaggaggcccacggcggcttctttatgctgagcgccatcccacccctgtcccagcactctctgtttctgatcgagaccaagcctttcaacccacagctgacaaatggcctggagctggactttcagctgagagccaaccccgtgatcacccgcaatggcaagcggtccgatgtgatgatgaacgccaagcaccaggccaaggccaatggcgtggagaaggagcggtggtgggagctgcagcagcaggcagcacaggcctggctggagcagcagggccagcagcacggctttagactgatcgccccagagcccgacgatttcgccatgtgggcaggcgacgagtacagcgagctgcaggcacactgcggatgcgtgcaggcctatcagcagcacagattcgtgaggaaggatcagcagaagccaatcaccttttcctctgtggacttctccggcgccctgtgcatcacagatgccgccctgtttaagcaggccctgttctccggcctgggcaagtctaaggccctgggctgcggcatgctgatggtgaagaggaagagaggcagcggcgaaggaagaggctccctgctgacttgcggcgacgtggaagaaaaccctggacctcccaagaaaaagaggaaagtgggtggcagccagctggtgaagtccgagctggaggagaagaagagcgagctgcgccacaagctgaagtacgtgccacacgagtatatcgagctgatcgagatcgccagaaatcccacccaggacagaatcctggagatgaaagtgatggagttctttatgaaggtgtacggctataggggagagcacctgggaggcagccggaagccagatggagccatctacaccgtgggctcccccatcgactatggcgtgatcgtggatacaaaggcctacagcggcggctataacctgcctatcggccaggccgacgagatgcagagatacgtggaggagaaccagaccaggaataagcacatcaacccaaatgagtggtggaaggtgtatcccagctccgtgacagagttcaagtttctgttcgtgtccggccacttcaagggcaactacaaggcccagctgacccggctgaatcacatcacaaactgcaatggcgccgtgctgtctgtggaggagctgctgatcggcggcgagatgatcaaggcaggcaccctgacactggaggaggtgcggagaaagtttaacaatggcgagatcaatttctctgctagcgagacacctggcacctccgagtctgccaccccagagtccggcggctctggctctagcggcggctctggctcctccggaggaatggacctgaccaaagagaagtggctgcctgtgatcttttctaacggcgagaagacaagaatcagcctgagggacctgctggataatcgcatccaggacctggcctatcctcggccagatttccagggagcagcatggcagatgctgatcggcatcctgcagtgtaccgtggccccagaggacaaggaggagtgggccgatatctggcacgagtctatcgagtttgagcagtgggagaaggccctgaacacaatcagcctggccctgcagttcggcgagcagaagccctcttttctgcagagcttcgaccctctggattccgagtacggctctatcgcaggactgctggtggacgcaccaggaggcaacgccctgaagctgaataaggatcactttgtgaagagaggcaacgtggagcagatctgcccacactgtgcagcaatcgccctgttcgccatccagaccaatagccctgcaggaggagcaggctatagggtgggaatgaggggaggaggaccactgaccacactggtggtgcctcaggaggaggacaagtacccactgtggaagaagctgtggctgaacgtgctgccacaggaggagccccctaatgtgacccagcacccactgatctttccctggctggcccctaccaagacatccgagaaggccggcaacgtggtgacacctgataatgcccacccactgcaggcctactggggaatgccaaggaggatcgagctggacttcacccacacagtggcaggaatctgcgacctgtgcggagagcaccacgagtccctgctgctgcagatgcgctctaagaactacggcgtgcagtatgactcttggctgcacccctttagcccttataggcaggccctgaaggacccctccgccccatggctggccttcaagggacagccaggaggactgtcttacaaggactggctgggcctgatgctgaacagggaggataagtttaataagatgcagccagcaaaggtggtgcgcgcagcaggccagcggaataagatgagcctgtggtgcttcgcctgggacatggataaggccaaggtgcgctgttggtaccagcacagaatccccctgatctccgtgtctcacgaggagcagttcctggccgtgctgaacatcgtgctggtgctggccagcgagtccctgtctctgctgcggaatgccctgaagagcgccaagtttgactgccctaaggaggccaagatggacttttccatggtggatatcgccttctggcaggagaccgagcctgccttcagaacactgcaggaggccctggcagtggacccactgagacaggatacccagacaaggcacgccgtgagccagtgggaggcagagctggcccactatctgtttcacgtgttcgaccgcgatgccctgaccaaccctgattgtccagacgatatcctgcagagacagctgacagcaaggcaggacctggcaagctcctacaggaagcacaaggcccggaaggatgtgctggccctggtggagtga

SEQ ID NO: 1248 - DNA, 5457 bp, Atlantibacter hermannii NBRC 105704
atgggccccaagaagaagagaaaggtaggcagcggcatgaacaacttcatcaacttccacgtgctgatctctcacagcccatcctgcctgaaccgggacgatatgaatatgcagaaggatgccgtgttcggcggcaagcggagagtgagaatcagctcccagtccctgaagagagccatgaggaagtctgactactatgcaaggcacatcggagcatctagcctgcgcacaatccacctggaggagctgagagatgtgctgaggcagaagctgtcccctcgctttgagctgccaatcatcgacaagaccctgtccctgctgtctggcaagacaatcgacgatgccgagaagatcaacggcgacgcagtgaccccatgggtgctgggagaggtggagtggttctgtgagcaggtcatgaaggccgaggccgagcagctggacgataagaagctgctgaagatgctgaaggacgatatcgccgccatgaggaccaatctgcagcagggagtggatgtggccctgagcggcaggatggccacatctggcctgatgagcgagctgggcaaggtggacggagcaatgtccatcgcacacgccatcaccacacacaccgtggactctgatatcgactggtttacagccgtggacgatctgcaggatctgggctccgcccacctgggaacccaggagttttcctctggcgtgttctacagatatgcctccctgaacatcgcccagctgcaggagaatctgggaggcgtgtctcgcgagcaggtgctggagatcgcagcacacctggcacacatgctggcaaccgaggtgccaggagcaaagcagcacacatttgccgccttcaaccccgccgatatggtcatgatcaacttcagcgacttcccactgtccctggccaacgcctttgagagccccatcaaggccaaggacggctacctgctgccttccatcaacgccttcaatgagtactggcagcggatcgccaagggatatggactgaccggaccagcagcacagttcatgctggcagaggccagcatggcaggaggaaacgtggtgtccgtggagaccctggagcagctgaagaagtggatctgccacgatggagaggccagccggggctccggcgagggaagaggcagcctgctgacatgtggcgacgtggaggagaaccctggacctccgaaaaaaaagcggaaagtgggctctggcatgagcaccgagatcgatgccatggccctgtataacgcctggcagcagctggacaatggcagctccgcccagctgaggcgcgtgagcgagcctgatgagctgagggagatcccagccttttaccgcctggtgcagccattcggctgggagaaccccgccaataagcgccctctgctgcggatggtgttttgcctgtccgccggcaaggacgtgatccaccacaaggagaagatcgacgattacccatccggcatctctctgggacgggccctggcaaagtctggcaagatcaacgagcggagagtgttccagctggtgagagcccagagcccaggcgatatgatccagctgaggcgcctgctgatccacgcagagcccgtgctggactggagcctgtttgcaaggcagctgacctggtggggcaagagggagagacagcagctgctggaggatttcatgctggccacacccgagagcaacaagaaggcaggctccggcgagggaaggggctctctgctgacctgcggcgacgtggaagagaaccctggacctccaaagaagaaaagaaaagtcggctccggcatgaagccatatctgatcctgagactggcaggaccaatgcaggcctggggacagcctacctttgagggcaccagaccaacagcaaggttcccaacacgctccggcctgctgggactgctgggagcatgcctgggcatccagagggacgatcggtctgccctgcaggccctgtctgagagcgtgcggtttgccgtgagatgtgatcagagcttcatcgacggccggaccatccctgtgacaggcctgagagattaccacaccgtgatggatgccagggaggactatcgcggcctgaagtctcacgagaccatccagacatggagggagtacctgtgcgacgccgtgtttaccgtggccgtgtgggagagcgagcaggccacactgaggctgccagagctgaaggtggccgtgtgcaagccccggtttacccctttcctgggcagaaagtcctgcccactgacacagcccctgttcgtggacctgtgcgacgccatcaacccttaccaggccctggcaaattatgcacctgcaggaggcgatatctattctgaggcacctccagacggaccatgccagacctttacagtgcgggacgagcctatcatcgccctgccaaggcagttcgcagcaagggagtggtacgtgatcaagggagcaagcgacgtgagccagggctctggcgaaggcagaggcagcctgctgacttgtggcgacgtggaagaaaaccctggacctcctaaaaagaaacgaaaggtaggctctggcatgtacctgagcaaagtgatcatccagaatgcctggtgtcgcgacgtgtaccagtttcaccaggccatctggcagctgttcccctctcagcctgcccagaagcgggccttcctgtttagaatcgaggcaaagcacccaggaaggggagcagacgtgctgctgcagagcatggaggcaccagcatctagcgccgcagcacaggtgctggcctgcaagcccctggcctttcacctgaaggagggcgatcagctgaggttccgcctgagggccaacccaatcaagaccatcaaggacgagcagcagcggctgaatggcagaggcgagatcaagagatgtagggtgcccctgctgaaggagcaggagcagcaccagtggctgatcaggaagctgtccctggcagcacgcctggagcacatcgagtccacctctgagctgcccctgttcttttctaagaacggcacaggcggcaagatccagcctatgaatttcgagggcatcctgaccgtgacaagcgtgcctgccctgctgtccctgctgaacaatggagtgggaccagcaaaggcaatgggatgcggcctgctgtctctggcaaggccaggcagcggcgagggaagaggctccctgctgacctgtggcgacgtggaagagaaccctggacctcccaagaaaaagaggaaagtgggtggctcccagctggtgaagtctgagctggaggagaagaagagcgagctgagacacaagctgaagtacgtgcctcacgagtatatcgagctgatcgagatcgccaggaatccaacccaggatcgcatcctggagatgaaagtgatggagttctttatgaaggtgtacggatataggggagagcacctgggaggctctcgcaagccagacggagcaatctacaccgtgggcagcccaatcgattatggcgtgatcgtggacacaaaggcctactccggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgagcggccacttcaagggcaactacaaggcccagctgaccagactgaatcacatcacaaactgcaatggagccgtgctgtccgtggaggagctgctgatcggcggcgagatgatcaaggcaggcaccctgacactggaggaggtgcggagaaagtttaacaatggcgagatcaacttctctgctagcgagacacctggcacctccgagtctgccaccccagagtccggcggctctggctctagcggcggctctggctcctccggaggaatggatctgctggtggacccatggattcccgtgcgggcctttgaggagaggcaccctcagaccatcacactgcagcggctgtgctgttccgaggagaagtggctgctgaatctgccaagagacgatatggagctggccgccctgcagctgctgatctgcctgctgcaggtgacctgtgagcctagggacgattctgagatgaggctgcgggtggcaaggccactgtctgaggaggagttcgccgccctgatgagcccttggcaccagacatttcagctggaccaccctcagatgccattcatgcaggtgaagggcgtggaggccaaggagccaacccccatggagaagctgatgaccggcctgagcggcgccacaaactgtgcctttgtgaatcagccaggacagggagaggccctgtgcggaggatgtacagcaatcgccctgttcaaccaggcaaacaatgcaccaggatttggaggaggcttcaagagcggcctgaggggaggaacccctatcaccacactgatcaagggctccgatctgcgcaccacaatctggctgaacgtgctgaccacaccccggctgcagtcctcttttcctccagacagactgaccgagaatctgcccacatggaagaggcctatcagctccggcaagacctttcctgcagcaacaatcggactgctgaggggactgttctggcagcctgcacacatcgagctgtgcccacctatcggaccaggacagtgctgtggatgtggacagcagtccaaccagcggtacaatggcttcctgaaggccaagtttaatttcacagtggagggactgtggcctcacccacactcccccagagtgctggtggagaagaagggcgtgatcgagcagaagtttctggccttcaccacagccgccccttcttggacccagatcggcaggctgctggtggataaggagacccgccagggagagggcaggcgcgtggccacagtggtggagcagtttcgggaggtgtaccctagattcaggctggccctgatcgtgggcggctatagaaacaatcaggccagcatcctggagcggagacacgatgtgctggtgtttaacgacggctggcagaatggctccgatgtgatcaacgacatcgtggagatgggcctgggctacaagaccgccctgaggaagggcctgtatacattcgtggagggcgccaagaatcacgacgtgaagggagcaggagtggcagtgcacgaggtggccgagcgccactactataggcgcagcgagctgctgatcccagcaatcctggcctccatcgattattctcagcctaacgacgtgatcgcaaggctgcggaaggagctgcaccagctgtgcgaggccctgttcaatcaggtgaccgcaccatacgcacaccacccaaagctgatccggtctctggcagtggcaagagccagcctgcacaagcacctgaacgagctgaagccacagggagagctggcatacgtggatggcgactga

SEQ ID NO: 1249 - DNA, 5448 bp, Geothermobacter sp. EPR-M
atgggccccaagaagaagagaaaggtaggctccggcatgcagaactttatcaattaccacgtgctgatctctcacagcccatcctgcctgaaccgcgacgatatgaatatgcagaagagcgccatcttcggaggcgtgcggagagtgcggatcagctcccagagcctgaagcgggccatgagaaagtccgactactatgcccagcacctgggcgaggcctctatcagaaccaagcacctgagcggcctgagggataggctgcacgagcgcctggcaggccggttcagccccgaagtgatcgacaagacaatcaagctgctgatcgacaaggatgtgagcgtggatggaatcgtggagggcgacgcagtggcaccatgggcagtggaggagtttgcatggttctgtgagagagtgatgaacgcacaggcagagggcctggaggataaggccctgaccaagcagctgaaggagtccatcgccgccatgagacagacactggtgggcggcctggatatcgccctgtctggcaggatggccaccagcggcctgctgtccgagctgggcaaggtggacggcgccctggcagtggcacacgccctgaccacacacaccgtggacgccgatatcgactggtttacagccgtggacgatctgcaggagctgggctctggccacctggacacccaggagttttctagcggcgtgttctacagatatgccagcctgaacatcggacagctgcaggagaatctgggaggagcaccaagggagcaggccctggagatcgcaacccacgtgctgcagatgctggccacagtggtgccctccgccaagcagcagtctttcgccgcccacaatctggccgatctggccctggtgtcctttgccgacatccccgtgagcctggcaaacgccttcgagaagccagtgcagcagaagaatggctctggctttcgggagccaagcatcgccgccctgcacgactactggcagaaggtgcacatcggctatggcctggaggagagatgcggccagttcgtgctgaacaaggtggagacccctgcaggaatcgcagcaaaggagtccctggaggatctgaagtcttgggtgcgcaacaatggagagggaggcagcggcgagggaaggggctccctgctgacctgtggcgacgtggaggagaaccctggacctccgaaaaaaaagcggaaagtgggctccggcatggccaaggagacagatttcatggacctgtaccaggcctggcagagactgccaaacggaccaaaggcagagctgaagaggtgcggcgatctgggcgacctgctggagaccagcgccttttacagactgctggcaggaaggggagaggcagagtggcagaagaaggcctatcagcggatgatcttctgcctgccctgtatcaatcacacagagcagaagatccctctgggagccgccctggcacggagcagaaagggcagccggagcgccgtgagcgagtctaggatgatccaggtggtgcgctccgaggcaccaaacgatatggtgcagctgaggcgcatcctgaagcacgcagagccaaccgtgaactggcctctgatggccaagcagctgtggtactgggacctgaatgagaggagcaagcggagcctgctggaggatttctttctgaaccacaccgacacaagcaaggagggaggctccggcgaaggcagaggctccctgctgacttgcggcgatgtggaggagaaccctggacctccaaagaagaaaagaaaagtcggctctggcatgggcgactatctgatcctgaagctgcagggacctatgcaggcctggggagagcacagctttgagggaacccgcccatccggcaatttccccacacggtctgccctgctgggactgctgggagcatgtctgggcatccggcggaacgagtacgagaggctgcagcagctggccgatagcgtgcagtttgccgtgagaaaggacgccaggcagacccagacagagtggggcgagccaaagaagctgcccatggtgaagatgaccgattaccacacagtgaaggacgccagacagtcttatatcggcctgaagagccacgagaccatccagacatggagggagtacctgctggacgccgagtattctgtggccatctgggagaatgaggatgcagccgtgagcctggacgagctggagaccgccgtgaggaagcccgtgttcaccccatacctgggcaggcgcagctgcccactggcacagcctctgttcggcaagcgcctgaccgcagagtccccaaaccaggccctgcaggcagtggagccttccggcggcgtgatctattctgagcagccctctgatcgcagcatgaggctgagggacctgcctatggcaggacagccaaggcagttcgcatctcggaccgtgtacatccacggaggcgatcacgtgtccgagggctctggcgagggaagaggcagcctgctgacatgcggcgacgtggaagaaaaccctggacctcctaaaaagaaacgaaaggtaggctctggcatgtacctgagcaaagtgatggtgaccggagcagcatgtaggaacccatatgagatccaccggtccctgtggcagctgttccccgaggaccccgacgcacggagagattatctgttccgggtggagagagcaggcaggcagcaggcagagatcctgctgcagagccagcggaagccaagcgactccgagctgcgcaaggtgcggctgctggcaaccagaggataccagccaaggctgcagcagggacagcggctgagatttgccctgctggccaaccctgtgaagacaatcaatgatgagaggggccgcctgaacgcaaagggacaggtgaagaagtgcagggtgccactgatcagggaggaggagtggagaagctggctggagcacaagctgatcggatgtgcagagctggagaccctggtggcagagaacaggctgcccatcaacttcagaaagccaaaggagaagagggtgggcaagatccagcccgtgagcttccagggcatcctgagagtgtcctctccagaggccatgatgcaggccatctctaccggcatcggaccagcaaaggccttcggctgcggactgctgagcatcgcaccagcaggctccggcgaagggaggggctctctgctgacatgtggcgacgtggaagaaaaccctggacctcccaagaaaaagaggaaagtgggtggctcccagctggtgaagtctgagctggaggagaagaagtccgagctgagacacaagctgaagtacgtgcctcacgagtatatcgagctgatcgagatcgcccgcaacccaacccaggatagaatcctggagatgaaagtgatggagttctttatgaaggtgtacggctatagaggagagcacctgggaggctccaggaagccagacggagccatctacaccgtgggctctcccatcgattatggcgtgatcgtggacacaaaggcctacagcggcggctataacctgcctatcggccaggccgatgagatgcagcggtacgtggaggagaaccagacccggaataagcacatcaacccaaatgagtggtggaaggtgtatcccagctccgtgacagagttcaagtttctgttcgtgtccggccacttcaagggcaactacaaggcccagctgacccggctgaatcacatcacaaactgcaatggagccgtgctgagcgtggaggagctgctgatcggcggcgagatgatcaaggccggcaccctgacactggaggaggtgaggcgcaagtttaacaatggcgagatcaatttctctgctagcgagacacctggcacctccgagtctgccaccccagagtccggcggctctggctctagcggcggctctggctcctccggaggaatgaacctgctgacagatccctggattcccgcaaggccacagggaagggcaaccgcacagaagctgacactgagacagctgctgtgcgaggacgagaggtgggagctgagactgcccagggacgatatggagatggccaccctgcagctgctgatctgtctgacccaggccctggcaacaccagcagatctgcccgagctgaagcggagaatcatgaagcccctgggccagcaggagtttaatgccgcctacaccccttttgccgattggttccgcctggaccacccccagtatcctttcatgcaggtgcggggagtgaaggcaaaggagccaacacccatggacaagctgctggcaggactgaccggagcaacaaacagctgttttgtgaatcagtccggcctgggagagggactgtgcccagcctgtgccgccatcgccctgttcaaccaggccatgaatgtgcctggctttggaggaggcttcaaggcctctctgaggggcagcgccccagtgaccacactggtgcagggagagcacctgaggcagaccatctggctgaacgtgctgtctacagagagcgtggaggccctgctgccatggcacaggcagaccgaggaccagaagcccacatggatcgcccctatcaagagcgagaccttcagctccagatccatcggctttctgaggggactgttctggcagccagcacacatcgagctgctgcctgcagagagcgtgggcgattgctcctgctgtggccagggcgacacagaggtgtacaggggctttaacaaggccaagttcaattataccgtgacaggaatctggcctcacccacacggagcacgcaccagcacagtgaagaagggcgagcaggaggagaagttcgtgagcttcaccacagaggcacctagctggacccagctgggccgctttgtggcaaggagggccttcgtggatgcaaagacacctggacaggagccagcagccgtgatcaggcaggcacagaagctgggcgtgcggctgaccctgtgcatcggaggctataggaacaatcaggccagcatcctggagcggagacacgagctgctgccactgggagagggatggaattccaagccccagatcgtgcaggatgtggtggacacagccatcggctaccgcgacgccctgaacaagtccctgtattctttctttaagggaggaggctccaagggagcaggactgcctatccacgagtttggcaaggcccagttctacaggcgcaccgaggaggccatcctggattccctggccagactggacttttctaatcccaggcctgtgctgctggccctgcagaagaagctggatacagaggtgagaggcctgttcgaggaggccgtgaggccatacctgaacgaccccaatctgatccacaccatggccgtgagccggagaacactgtataagaacctgaatgtgctgaagccacagcaggagggaggagtggacggcaagagaaactga

SEQ ID NO: 1250 - DNA, 5484 bp, Methylocaldum sp. 14B
atgggccccaagaagaagagaaaggtaggcagcggcatgaccaagaagaactttatcaatttccacgtgctgatcagccactccccttcttgcctgaacagagacgatatgaatatgcagaagacagccgtgttcggcggcgtgaatcgggtgagaatcagctcccagtccctgaagcgggccatcagaaagtctgactactatcaggccaacctgggagcaccaagcgtgaggacccgcgatctgaataagctgaaggcccggtttacagagctgctgaaggacagattcgatgccgagctgatcaacagggccctggagtggatctccggcaaggagggcatcgcagagggagtgaccgcagacgcagtggccccatggtctgtggatgaggtgacacacttttgtgagatcatcagcgccgacgatcagcaggacatcaagaagctggagaagcagatcgagaaggaggcaaggcccttccgcgcagcaatgagcaacaccgtggacatcgccctgtccggcaggatggccacatctggcctgatgagcaatctgccagtggatggcgccctggcagtggcacacgcaatcaccacacacgccgtggagcctcaggacgtggattggttcaccgccgtggacgatctgacacaggacgcaggcgataccggagcaggacacctggatacccagcagttttctagcggcgtgttctacagatatgcctccctgaacctgcgccagctgcaagtgaatctgggcctgatcgaccacatcaaggcagaggagaccgcagagtctcggcagagagccctggatatcgcccaccacgtgtttcacctgctggccacagtggtgccttccgccaagcagcagtctttcgccgcccacaacctggccgactttgccatcgtgagcttcgccgatcagccaatctccctggccaatgcctttgaggagcccgtgcggagagactacaagctggccggcttcctgaagccatccatccagtgcctggccaactactggggccggatgaatagagcatatggcctggacgagcaggcaagggcctttgccgtggatgccagcttcgagatgggcggcaagccccctctggattccctgaaggccgtggaggactggatcgccgaggatggacaggagggcagcggcgagggaagaggctccctgctgacctgtggcgacgtggaggagaaccctggacctccgaaaaaaaagcggaaagtgggcagcggcatgacagcagagctgccagattttgtggccctgaagatgcactatgacgatgagtccttccccaccggagcaagggcagagctgaggcgcgcagccgagcctgacgatgtggccctgacaccagccctgtacaggctgtttcctggagagaggccatctgacaggcacctgcgcgtggcatacctgctgccctatgccaagcacgccgccaaggccaagagcctgggagcacagctggcagaggcaaaggtggccgaggcccgggtgctgcaggtggccagagcacacgagcccctggacgtggtgcagctgcggagactgctgatgcaggtggaggcagcagtggattggtccgcctttggccctatggtgtggttctggaacgagcgggccaagagacagctgatcgaggacttttatatcgcccgcttctctccagtgaccggagcaaagggctctggcgagggaaggggcagcctgctgacatgcggcgatgtggaggagaaccctggacctccaaagaagaaaagaaaagtcggcagcggcatgcctcggtacctgatcctgctgctggacggaccaatgcaggcctggggaacacacacctttgaggatttcagaccctgcaacgccttccctaccaggagcggcctgctgggactgctgggagcctgtctgggcctggacaggcgcgatacagaggccctggagcagctggccatgtccgtggagtttgccgtgagggcagacagggaggtgctgaggccagaggcagaggtgccaaaggcaaaggcagcagtgaagctgccagatttccacaccgtggaggacgcccgcaaggtggatggctctgccaacaagaatcccgtggtgagccggagagagtatctgtttgacgcagccttcaccgtggcaatcggagcaaagcctgacggaccagtgacactggatgcaatcgcagaggccctgaggcgcccctgctttacccctgtgctgggccggagatcttgtccaatcgccagaccactgctggacggagaggcagtggaggccagcgatgccaaggccgccctggcaaccatcgcaccagtgggcggcatgatctatacagagggagagctgatctccgcccagccactgagggtgcgcgacgtgcctatccagggccggcacagacagttctctacccgcctggtgtacctgcacaagggcgagacatgcagcggctccggcgagggaaggggctccctgctgacttgcggcgatgtggaagaaaaccctggacctcctaaaaagaaacgaaaggtaggcagcggcatgtttctgtcccgcgtggagatcccatgggacgccgtgcggaacccctacgagatccacaggcagctgtggaggctgttcccaggagaggataaggagcctcgcaagaatgccgaggagggcaggcagggcttcctgtttcgcgtggagaacaatcagcccggccggcctctgagactgctgatccagagcaggagggcccctgagccaacagcaggactgaccatcgtgggcacaagagagtttcagccacagcctgcacacggacagaggctggccttcctgctgacatctaaccctgtgaagaccatcatcgacgcccagcgcgagaccaagagcggcaagtcctctgagaagtgccgggtgccactgatccacgagtccgagcagagggagtggctgaagaggaagctgatcggagcaggagagttcgagggagtgaacgtggtgccacacgcacccgtgttctttcggaagggcaatagaggcggcaagatcgtgatggtgacctttgagggcgtgctgagggtgaacgagccaggcacactgatcgcctatctggagaatggcatcggaccagcaaaggccttcggctgcggactgctgctggtgcggagactgggaggctccggcgagggacgcggctctctgctgacctgtggcgatgtggaagaaaaccctggacctcccaagaaaaagaggaaagtgggtggctctcagctggtgaagagcgagctggaggagaagaagtccgagctgagacacaagctgaagtacgtgcctcacgagtatatcgagctgatcgagatcgcccggaacccaacccaggacagaatcctggagatgaaagtgatggagttctttatgaaggtgtacggctataggggagagcacctgggaggctcccggaagcccgatggcgccatctacaccgtgggctctcctatcgactatggcgtgatcgtggatacaaaggcctacagcggcggctataacctgcctatcggccaggccgacgagatgcagagatacgtggaggagaaccagaccaggaataagcacatcaaccctaatgagtggtggaaggtgtatccaagctccgtgacagagttcaagtttctgttcgtgtctggccactttaagggcaactacaaggcccagctgacacgcctgaatcacatcaccaactgtaatggagccgtgctgagcgtggaggagctgctgatcggcggcgagatgatcaaggccggcacactgaccctggaggaggtgaggcgcaagtttaacaatggcgagatcaacttctctgctagcgagacacctggcacctccgagtctgccaccccagagtccggcggctctggctctagcggcggctctggctcctccggaggaatgaatctgctggaggacccttggattcccgtgcgggcagatggaggaaccggagcattccagctgctgacatacaggcagctgctgtgcgagccaggaaactggcaggtgagcctgccaagggacgatctggagctggcctgcgtgcagctgctggtgtgcatgacccaggtcatgtttctgcctgagaatgacgccgtgtggaggaagcgcctgaccgaggccctgacaagagaggagttcacagccggcaccgagccatgtctggactggtttgacctggatcaccccacccagcctttcatgcagtctaggggcgtgcgcgcagcagaggatacaccaatccagaagctgctgatcggcctgcctgagggcaacaatcacgccttctttaatgaggcaggagaggtgcggcacctgagcgtgaccgtggccgccatcgccctgttcaaccaggccacaaattgcccttcctttggcggaggcttcaagggctctctgaggggaggagcaccaatcaccacactggtcaacggcgagaatctgcgggagaccgtgtggtgtaacgtgctgacacggtccagactggcagcaaggcagatcgcaatgccaggcctggacagggataggcctacctgggtggagccaatccaggagaaggccaccatcccctggaatacaatcggactggcaaggggactgttttggcagcctgcccgggtggagctggtgagaagcatggcagcagcaccttgcgacgtgatgggaggagcaccaaccctgggatatgtgggcttcagaaaggagaagtttaacttcacagtggagggcgtgtggccacacccacacggagccatcacaatgaccctgaagaagggcgccctggagcagaagtttgccagcttcaccacaaccgcacctgcatggacccagctgtccgagttcgtggtgccaaagggagtgaacgatccaggagcaaaggagggctccatcccagcaggaccagtgacccaggcctccgagctgggagagtctggcctgcacctgctggtgggaggatacaggacaaatcaggccagcgtgctggagcggagacacgagatgatgtccctggcccggggctggagagacgataagagccggctgccaaagctggtggagatgggcaaggaggccaagaaggccctgaggggcaagctgtattttgccgtgcagggcaacaaggacaagggcctgaagggaatcggagcagcaatccacgagaccgccgagaagctgttctacgccagaacagagtctctgatccacgagaccttcagcaatgagctgaccttcaagcagtgggccacagccagaaaggcctttgtgcaggagctggcaggacactgtagggcaatcttcgaggagctgaccgccccctacgccatgaagcctgagctgatcccagtgatcgcatgggcaaggcgcagcctgaacttcgacctgacaaagctgatggaggatgcctga

SEQ ID NO: 1251 - DNA, 5910 bp, Methanocella arvoryzae MRE50
atgggccccaagaagaagagaaaggtaggcagcggcatgaagctgatcgagatccacatgatccagaaccacgccccctgcaacctgaatagagacgataccggcagccctaaggactgtatgtttggaggcatccggcggagccggatcagctcccagagcatcaagagatccatcaggatgtctcctatcttcaaggaggagatgaagggcatcgagctggccaatcgcacaaggcgcctgccagagctggtgaaggccaagctgatctccgatggcatcgacgagaagatggcagcaatcgcagcagagaaggcaacaggctttggcaccaaggatggcaaggagcgggaggaggacctgaatacagcccagaccatgttcatcacccagtccgacgtggatgccgtggcctctgtgatgaaggatgccatcctgaaggccggcaaccccaaggccttcaaggatatgaaggcagcagacctgcagaaggcagcagagctgaagggatggagaccagtgacacctgacctggccctgtttggcaggatgatcaccagcgatgccttcatggacatcgaggcctccatgcaggtggcccacgccatctctacaaataagatggatcacgagtttgactacttcaccgccgtggacgatctgcagaagtctagcgacggacctggagcagatatgatcggcgacgtgcagtttaacagcgcctgctactataagtacttctccctggactatgatgccctgatccagaacctggccggcctgaagccaggcgataatgccaccgaggccgacaagaaggcctatgccgagtccctggagaatgccaagaaggtggccgccatcaccatcacagcctttctgaaggccgccatctacaccacaccatccggcaagcagaactctttcgccgcacaccagctgccaagcgccgtgctggtggagatcaggccaaccaagacacccgtgtcctacgcaaacgccttcgtggaccccgcaaggccccgcaatggcgtggatatggtggaggacaccctgaacaagttcgtgaagcacgtggagctgcagacagagaagtttaacctgcggagcacccggagactgtggttcgtggcaggcgacaaggccctggcaggaaccgagacatgccagacaatcaacgatctgatcagcggcatcaattccgccctgggctctggcgagggaagaggctccctgctgacctgtggcgacgtggaggagaaccctggacctccgaaaaaaaagcggaaagtgggctctggcatgacagccccaaacgagaataaggagcaccagaagagcaagaaggacgaggagttcctggccaacctggcaaagatggcagagagcgataggggaggaatggccatcctgaagcggaacgccggcaatacaatcgccgagagccggggcgccatgaagaccttttacagcctgctgccatatggcatcagcgactccccctacgaggagatctatttcctgatcgccaccctgtacggccacaacaagtataggtttacaggcgacttcggccagaccatgaagctggtgcgcgagtcctctaattctgagagcatcgatcagcgggtgagcacactgctggattccgagtttaacatcgtggacggcatcaagccaggaggaggagagctggcatacaggctgaggcagtgcgtgaagctggcaagcggccacgagatcggagtggattggtatagactgctgcaggacctgaagtactggggctatccagagaagagggtgcagaagcggtgggcccggtcctacttcggctatggcaagcccgtggagtctgagaccaaggagagcaaggaggaggcaaaggcaggctctggcgagggcagaggcagcctgctgacatgcggcgacgtggaagagaaccctggacctccaaagaagaaaagaaaagtcggctctggcatggataacccactgctgctgctgctgcggctggagggaccaatgcagagctggggcctgaaggcaagatgggatatcagggacacaggcgatgagcccaccaagagcggcatcatcggactgctgggatgcgcactgggatacgccagaaaggaccccaggctgaccgacgagctggattcccagctgcgcatcggcatccgggtggagtgtcctggcgagatcgccagggactatcacacagtgagcggcgagctgcgcaccgcagagggcaagctgcgggagaccacaatcgtgtcctttagagattacctgcaggacgcagccttcctggtggtgctggagggaccaggagagctgctgaccaggatctccaacgccctgaaggaccccgtgtggccaatctacctgggcagaaagtcttgccctccaacaaggcccgtgttcgagaccctgaccacagactatgcctccatcgacgatgccctgagccggcacccttggagctccggcaccatggaggcaaggaaggcacacccaaaggagctgaagtgtatcgtggaggacctgtctggcccataccagagaacagataggatgaccaagagccccgccagaatgtatggcatccgccacgtgcggatgagcaccgtgaagctgcaggcagagggagagggactgggcagcggcgagggcaggggctccctgctgacctgcggcgacgtggaggaaaaccctggacctcctaaaaagaaacgaaaggtaggctccggcatgtacctgtctcggctgatcctgaaccctaggacccgcgccgtgaggcgcgacctggcagattgtcacgagctgcaccgcacaatcctgggcggctttccagacctgaacggcaagggaggagaggcaagggagaccttcggcgtgctgcacagaatcgatatccacccaaggagcggcgcaatcgtgctgctggtgcagagccaggagaagcccgactggtccaagctgcctgagggctacctgctggagaacaccggcacagagaatcctgcctgcaaggccatcgacgagcagtacggcaagatcaaggcaggcgacgtgtacgccttccggctgagagccaatccaacaaagaagatcggcaccagccggatcgaggatatcaaggccggcaagcccaagaacaatggccggagagtgcctatccgcaacgagagcgaccagatcctgtggctgaagaggaagggagcagcaggaggatttgagctgatgagcaccaagaggttcagcgagctgtccgacgtgctgatctccgaggagggccaccagaagatctatacattcgataccggcatcaaggccaaggtgcagaagaacgccagagagaataggctgacctttggcagcgtgctgttcgagggcacactgaaggtgaccaatgccgagaagtttctggagacactgaagagcggcatcggctccggcaaggcctacggattcggactgctgtccctggcacctgcaaggggctctggcgagggacggggcagcctgctgacttgcggcgatgtggaggagaaccctggacctcccaagaaaaagaggaaagtgggtggcagccagctggtgaagtccgagctggaggagaagaagagcgagctgcggcacaagctgaagtacgtgccccacgagtatatcgagctgatcgagatcgccagaaatcctacccaggatagaatcctggagatgaaagtgatggagttctttatgaaggtgtacggctatagaggagagcacctgggaggctccaggaagcctgacggagccatctacacagtgggctctccaatcgattatggcgtgatcgtggacaccaaggcctactccggcggctataacctgccaatcggacaggcagacgagatgcagcggtacgtggaggagaaccagacccggaataagcacatcaacccaaatgagtggtggaaggtgtatccctctagcgtgacagagttcaagtttctgttcgtgtctggccactttaagggcaactacaaggcccagctgacacgcctgaatcacatcaccaactgcaatggagccgtgctgtccgtggaggagctgctgatcggcggcgagatgatcaaggccggcaccctgacactggaggaggtgaggcgcaagtttaacaatggcgagatcaatttctctgctagcgagacacctggcacctccgagtctgccaccccagagtccggcggctctggctctagcggcggctctggctcctccggaggaatgaagaatcgcgtgaagcggggcgagcacctggtgtcttataacctgctgacagagccttggatcacctctatcgatctgagcggcaatccagtgcaggagggcatcctggccaccctgaagaacgcccacaagatcgatagcatctttgaccctgcccctccagtggagttcggcatctacaggctgctgatcgcctttatcaccgacgtgttccagccacagggcctggaggacctggcagatctgctggacaggaagcggctggaccccacagccctggacgagtacgcagcacggtggagagataggtttgacctgttcgatgagaagtatccattcctgcagcaggccatcaccggcgtgatcaagaagccccctgagcccatctctcgcctgatgcagcacctgcctgccggcacaaatgtgagccactttcaccacggccggtgggacgagaactcttttagcttcgagcagtgcgccaagggcctggtgacaatcgcacccttcatgaccgcaggaggagcaggcctgtccccttctatcaacggcagcccaccctggtacgtgctggtgaagggcaacaatctgtttgagacactgctgtataacgtgtgccagatccccatgaccgtgaagcctatcggcgatagcccagtggcctggagaaacgacaagaggatcgaccctggcgatgagccaaagacattctccatcgtggagggactgacctggaggcctcggatcatccagctgatcccaggcaatggcaagggcacctgtacatataccggcgagaaggacgtggataccgtgtcccacatgcactactatccaggccagaagtctcctgagccaggactgtgggtggacccccaggtggcatacaagaagacaaaggatgccatcagacccctgaggcctgacgagaataaggccctgtggcgcgatatcggaccactgatgctgctgcagcacggcgattactctggcaaggacggcaaggtgagcttcgatcggccagccgtggtgacccagtataagcagatggtgtccaacggcatgatcaagcggagcgagccactgcggctggaggtgtacggcatccgcacagacggcaagatgaagatctacgagtggtatcacgagaagctggccctgcccatcgagatcctgaagaaggccaattccggccggcagatccaggacgccatggatctggccgactctgtggcctacatcctgagaaaggccatgaagaaggcctatcctaggaacgccaagtccaatgagtctggctttgacaacctgatcctgagcgtgcagtctagctattggtcccacctgaagggccagtttgagtctatcttcctgaagacactgagccagcaggatgagaatgacctggatgcctacaccaagctgatggagcagtggaagaagatcctggacgatacaggcaagaacgccctggacaagggactgggacccctggacaccgatggcgactccctgcggagacaggtgaaggccatgaacgagtactcctctggcatcagattcgccctgtatcctgactctatccaggccaagaagaagaacaggcagaagaataaggaggataagtga

SEQ ID NO: 1252 - DNA, 5592 bp, Pseudomonas aeruginosa DHS01
atgggccccaagaagaagagaaaggtaggcagcggcatgaacctgtttatcgagttccacctgatccagaattttgccccatccaacctgaatagggacgataccggagcaccaaaggacgcaatctttggaggacacaggagagccagagtgagctcccagtgcttcaagagagccatcaggctgaccgcccacgagcaggagctggtggcccccgagcacaggggcgtgcggacaaagaagctgaaggccctgctgctggagaggctggcaggacgcgatcctgcagaggcagagggcaagatcgagaccgccctggcagcagcaggcctgaagctgaaggacgatggcaagacagagtacctgctgtttctgggagaggcagagatcgcaggattcgccgccctgatcgagcagcggtgggacgagctgggcagcgccgcaccagccggcgagaagaagggcaagaaggaggccaaggccaacgtgcccaccgaagtgatcaagcaggcaagggccctgctggatggaggcaaggcagtggacgtggccctgttcggaaggatgctggccgatctgccagaggtcaatcaggacgcagcatgtcaggtggcacacgcaatctccacccacagggtggagagggagtttgactacttcacagcagtggacgataggggaggccccgatgagtctggcgcaggaatgatcggccaggtggagtttaacagcgccaccctgtacagatatgcagtggtggacctgcgcaagctgctgggaaacctgcagaatgatggagagctggtgctgtccgccctggaggccttcacccaggcaatggtgcgcgcaatcccatctggcaagcagaacacatttgccgcccacaatctgcctgccttcgtgggaatctgcctgaggcacgcaggaccactgaacctggccaatgcctttgagaagccagtggtggcaagggcagacgcctccctgtctgagcggagcgtggcagagctggcaagacacgatcagcagctggcaagcgtgtacggcgacagccgggatagatgggcctatctggacatctccggcgcatggccaaaggagagaggagagccagcaggaaacctgcagcagctggccgattggctgaggtctcaggtgtctagccgcctgggaggaggcagcggcgagggacggggctccctgctgacctgtggcgatgtggaggagaaccctggacctccgaaaaaaaagcggaaagtgggcagcggcatgtccgccgcagagcacccattcatcggacacctgcagaggctgcagaatgacaggggcgccctggccgtgctgaggcgcagcctgggatttgcacctggagcatatgtgccagcatacccatatgtggagcggttcgtgggagcagagagacacgcacaggatgcctggaggctggccctgtacctgaccgcaggactgtttgcatcccacccaggacagggaagggcctctctggcaatgaggttcggagagctgatgaaggccaggaacagcgcctccatcgagaagcggttcatcgccctgctggcagcagacgcagagaatctgcccgtgtatctgagacaggccgtgagcctgctggcagcagataagctggccttcgactacggcgccctgctggacgatctggcacactggctggacccctatctgccagtggcaaggggcgacgcaatcaggcagcggtgggccagagacttctacgccgccctggccaacaccacagatacctctctgcacaaggacggcagcggcgagggaaggggctccctgctgacatgcggcgacgtggaggagaaccctggacctccaaagaagaaaagaaaagtcggctccggcatggccaccctgctgatgaggctgcagggaccaatgcagtcctggggaaccacatctcggttcgacgagagagatacacagctggagccttctaagagcggcgtgctgggactggtgtgcgccgccctgggaagggatagaagcgagccactggaggacctggcctccctgcggatgggcgtgcgcgtggatagggagggcatccccctgagagactatcagaccgcaacaggcgtgctggtggcatccggcaaggccgatcccaggagaaccgtggtgtctcctcggcactacctggccgacgccgtgtttctggtgggcctggagggcagagatcaggccctgctggagagaatccagcaggccctgagagcaccattttggcctctgtgcctgggaaggaagagcttcgtgccaggctcccccgtgtggctgcctgagggactgtcctctctggccctggagcaggccctgcaggcctggccaagactggcagaggcacagcctggcgacaggggcaagccactgagatgtctgatcgaggacgagaggagcggcgtggtgcgcctggatcagcctatcgcaccattcgccgagaggcgctttggaccaagattcgtgaggtccggcgtggcagacgtgcccgatcagaccgaccctggctctggcgagggaaggggcagcctgctgacctgtggcgacgtggaagaaaaccctggacctcctaaaaagaaacgaaaggtaggctctggcatgtatctgaccaggctgaccctggacccccgcagcgcccaggcacggagagatctgggcgacgcctacgagatgcacaggaccctgagccgcgtgtttgcagacgagcaggcaccagcatcccggttcctgtggagactggaggcctctggcaacgcctggagcacccctacactgctggtgcaggcagcatccgagggaaattggtctgtgctgcaggccctgccaggatacctgctgggagagccacagtccaagtctctggccctgaggcagtggctggagtctgacatcagctacaggtttcgcctgttcgccaatcccaccgtgacaaggcagggcaagcggtacggactggtgggagaggagcagcagctggcatggctggcaaggcagggcgagagacacggctttgtggtggaggccgccctggtgaccttcagcgaggtgctgggctcccggaagagacagacacggatctccgtgctgagagccgcctttgagggcaggctgcgcatctctcgcccagatgccttcggccaggccctggtggcaggaatcggacccgccaaggccttcggctgcggcctgctgtccctggcaaggagcggctccggcgaaggcaggggctctctgctgacttgcggcgacgtggaagaaaaccctggacctcccaagaaaaagaggaaagtgggtggctctcagctggtgaagagcgagctggaggagaagaagagcgagctgagacacaagctgaagtacgtgcctcacgagtatatcgagctgatcgagatcgcccggaatccaacacaggatagaatcctggagatgaaagtgatggagttctttatgaaggtgtacggatataggggagagcacctgggaggcagcagaaagcctgacggagccatctacaccgtgggctccccaatcgattatggcgtgatcgtggacacaaaggcctactccggcggctataacctgcctatcggccaggccgacgagatgcagaggtacgtggaggagaaccagacccgcaataagcacatcaaccctaatgagtggtggaaggtgtatccaagctccgtgacagagttcaagtttctgttcgtgtctggccacttcaagggcaactacaaggcccagctgacccggctgaatcacatcacaaactgtaatggagccgtgctgtccgtggaggagctgctgatcggcggcgagatgatcaaggccggcaccctgacactggaggaggtgaggcgcaagtttaacaatggcgagatcaatttctctgctagcgagacacctggcacctccgagtctgccaccccagagtccggcggctctggctctagcggcggctctggctcctccggaggaatgaccgagcactataacctgctggacacaccatggctgcctgtgcggctggcaaatggagaggtgagagagatgggcctgctggaggtgtacagggaggcagagaggatctctgccctggcagagaccgagccacccagcctgatcgcccagtaccggctgctgctggccatcacacacagagccctgctgctggagtatggagcatggaaggactccggccggctgagatggtttagggagggcctgcctatcgatgtggtggagcggtacctggagcggtggagggagcggttttggctgttccacccacagtatcccttcatgcaggtggccgccctggcaagcgccgcagagacctgcgataagcagaagccatgggcacagatcagcctggcatccgccaacggcaatacacctgtggtgttcgatcactcctacgacctggccccatctgccgtgagcgccgaccgggccctgtgcgcactgctgggctttctgcagttcaccccaggaggactggtgaagacagtgcgcgacagcgataaggcaggcgccctggcaaacaccgcagcagtggtgccactggcagacagcctggcaaagacactgtgcctggccctgcacccagcatccggcgaggcagcctttgatctgcctgcctgggagagagaggccctgaccatcccacagctggcagccgaccctatcctggcatccggcccaaatgatcgctatacacggcagagccgggccgtgctgctgctgcccgaggaggagggctgcgtgcggtggatcagattcgcagcaggacaggccctggcagacgatgtgcaggcccctgacccaatggccagctacaggcctggcgccaacaattccatggtgcgcctgtcttttggcgaaggccgggtgttctggagagatctgcctagcctgctgccagactccgccgcagcaggctctaagagggcagccgtgctggactgggcaagcaacctgcgctccatcggagcagatgcacctagctccatgctgctggtggcaggactggcaagcgatcaggccaagctgctgagatggaggtccgagaccgtggtgctgccagccgccctgctggactctgagggatgcgcaaacgagctgcggagatgtatccgggagagcgaggatctgtatggcgagctgagaaagatcgcagtggcaatgctggcagaggccctgcccgatcctgcatctaaggacacctgggcaagggcacggaccagcttcgacaatggaccagcagcagcaacatacttcgcactgctggagaggtccctgccttctctgatggccctgatcggcggcgatcgcctggagatgctggacgaggcagaggccttctggagatctaggctgctggccgccctggaggtggcatggcagggcgtgcgggagggactgggcctgagcgtggccgccctgagagcagaggcaaaggtgcgcccaaggtacctggccctgctgaggcgctatcggagcgagagaacctctagcacacccctggccgaggagcagtgcgcctga

SEQ ID NO: 1253 - DNA, 5562 bp, Lachnospiraceae bacterium KH1T2
atgggccccaagaagaagagaaaggtaggcagcggcatgagcaattccaagtaccagtttctgaacggcaagaagctggccgagttccacatgctgaagctgtatcctagctccgccctgaacagagacgatgccggcgagcagaagaccggcatgtataatggcacactgaggaacagaatctctagccagtgcatcaagcggtcttggagactgagcgagacctttgaggacgtgttcgatgagatcggcatcaggacaaagcgcatgccagagtacgtgggcaagaagctggtggagaatggcgtgcccgaggaggatgtgatctcttttaagaagatcctgagcggcgagaaggtggacgagaagtcctctaagaagtccaaggccgaccaggccatcgatgagggcaagcctgtgaagaccgccgccctgagcttctactccgtggaggagctggataagatcgccgagatctgcaagaggatctatgacgatctggaggagccaaagtccaagaatctgaagacaatcaagatcgacaacatccagaaggagatgcgcaagtgcgtgcaccccatgaatatcgatgtggccgcctttggcaggatggtgaccgacaacatgctgaggcctgtggagggagcaatgcaggtggcccaggccctgtctacaaatgccgccgtgaaggagaacgattatttcgtggcctgcgacgatctggtgaagggagagaccatcgaggacgtgggaggagagatgctgggcgacatcgattacaatagcgcctgctactatatccacgccaacgccgatctggagcagtttgccgagaatctgaaggactgtgagaacatggaggagatcgtgaaggccctgccatctaatatggtggaagtgatggcctacaccgaccccacagccaggcagagcaccatggaggcccacgtgctgcccgaagtgatctacgtggagctgaagagcaagaagcggccactgaacagaatgaaggccttcgccgagccctgtaaccgcaatatcgccgagaagtccgccaagaagctggccgattacatcaattgcaccaacgagaaggccgacctgggcatcacaaatgccctgtggtattgtgaggatgagagcgtgaaggccccagagaatgtgaccgtggtgaactccatcaaggagctggagcagaagctgaatgagtggatgaacgagggctccggcgagggaaggggctctctgctgacatgcggcgacgtggaggagaaccctggacctccgaaaaaaaagcggaaagtgggctccggcatgatccaggaggcctacgagaagctggcccacgaggagaagcggctgtttgcccactgtgccggcaagctgatcaaggacgccccaaaggccatcatccccttctacaaggtggtgccctccgagatcgagtctaaaaacggcaagaagtataccgtggacgaggatgccttctttgccgccctgtgcgtgaggtgtctgtttgagaagatcgagggcgtgacactggagcccgatatcctgatcagcgagggccgcaagaatcctaagatctccctggagggctatgaccggagaatcagcgccctgatgtccaacaccgaggccgagttctttatccctaagctggccaagctgatgaattacaccctgaagatcacatccaacaagatcccagactgcgatcagctgtattgggatatccacaatatcggctctaacgagaaggacgtgcagaggcgctgggcaaggaccatctacgtgaacaatgaggagggcagcggcgagggaagaggctccctgctgacatgtggcgatgtggaagaaaaccctggacctccaaagaagaaaagaaaagtcggcagcggcatgaagatcaagatcgtgctggagggagcattccaggcctggggagtgccttccgagtatacctggcggggcacatcttactatccaaccgccagaggcatcgtgggcctgatcggctgctgtatgggcatccctaggggcgacgatcgcctggagcagctgctgtccgtgctgaagatcacctacgacatcaacgaggacgataacggcaatcggaagtctggcagcatcctgacagattttcaggtggtgagaaaggaggacggaggcaagctgaatgcagcaaacggaggaaccggcgatagctacggcatcatcctgcacaagtcttatatcaatgacgccagcttcacagtgcacatcgagggccctgacgatctgatgaaggacgtgtacgatgccatgctggaccccgtgtgggtgccttatctgggcagaaagaattgccctccaaccgagccactgatccccgagattgaaggctccggcgaaggcagaggctctctgctgacctgtggcgacgtggaagaaaaccctggacctcctaaaaagaaacgaaaggtaggctccggcatgtacctgaccaagctggagctgaatatccagaacaaggccgtgctgcacaatatgtctaactgcgagtggatgcacaagctgatcctggagaagggctttggccacatccaggccgagaatgcccggcagacactgaagatcctgtacgccgtggatggcatcaaggtgtatgtgcagtccgccgtggagcccaagttcgagaactgttcttactggatcagcacccctgccacaatctgcatcgacgccatgaagaagatctgtggcaccggcatggccgtgcactttaagtgcacctgtaaccccacaaagaagctgatcgatggcggcaagagaatcttcctgagctccgagcgggagagagacgagtggatcaagagagtgatggagagaagcggcgccgaggtgctggtggagtctcagaccagcgatttcacagtgtggggcatgaagaaggacaagaagaccgataagtcccacaagatctacgccaaggccgtgacctattctggcgccctgaagatcacagacgaggagaagttttgggaggccttctgcaatggcatcggccgggagaaggcctacggctgtggcatgctgatgatccaagtcggcagcggcgaagggaggggctccctgctgacctgcggcgacgtggaagaaaaccctggacctcccaagaaaaagaggaaagtgggtggcagccagctggtgaagtccgagctggaggagaagaagtccgagctgagacacaagctgaagtacgtgcctcacgagtatatcgagctgatcgagatcgcccggaacccaacccaggatagaatcctggagatgaaagtgatggagttctttatgaaggtgtacggctataggggagagcacctgggaggcagccggaagcctgacggcgccatctacaccgtgggcagcccaatcgattatggcgtgatcgtggacacaaaggcctacagcggcggctataatctgcctatcggccaggccgacgagatgcagaggtacgtggaggagaatcagacccgcaacaagcacatcaaccctaatgagtggtggaaggtgtatccatctagcgtgacagagttcaagtttctgttcgtgagcggccacttcaagggcaattacaaggcccagctgaccagactgaaccacatcacaaactgcaatggagccgtgctgtccgtggaggagctgctgatcggcggcgagatgatcaaggcaggcaccctgacactggaggaggtgcggagaaagtttaacaatggcgagatcaacttctctgctagcgagacacctggcacctccgagtctgccaccccagagtccggcggctctggctctagcggcggctctggctcctccggaggaatgtgcgatcagcagtacgtgtctacactgaatgtgctgaaggacccttggattcccgtggtgtttctggacggcaagatcaaggatgtgggcatcatcgagtgtttcagaaacgccgagaagatcaagaccatctctaacagcaagccatatgagaagatcgccatcctgagatttctgaccgccttcatcacagacgtgtaccagctggataggcgcatcgagaggcagaagctgtatgacgccggctctttcgagatcgagcgcatcgagaattacgtgaaggagtgcgaggagaagaacggcgccagctttgtgctgggcgatagccagcggtccttcttttgtttcaactacaatccccaggtggacaccgagggagtgaagctgagcgccgcctatctgcacctggagctgcctcacggcaacaatccaatccacatcgtggcccagagggaggaggactttgagggcgatacactgccacagttcctgagggccgccctggcctttaatctgttccctaccggcaacatgctgaagggcgccaattctaagacaggcgacaactgctacatcgatggcgtgggcaaggacggcaagcctaagtacaccgccgcctatggcagcatgggcatcaatgcaggctctagcatggcagcagcagagcccgtgttcttttggcctgagtgcgataacctgtttcacacactggtcatgtgcatgaggtcccagggcgagctgcagaacaatctgaagctgaacgatcctccagccttctggaatgcagacgcagagccaaaccctaaggcaggcaagaggggcgacatcgtgaccagcgtgagcttcgtgagcggcctggcattccaggcaaggagaatcgtgccagtgatcgagaatggcaaggtgtacgagtgttatatctctaacggctacacaaacagcaatgagaacgtgtggcacgatccatttgccgtgaggctgcgcaaccacaagtccggcgagatcttccagatgccagcaaagggcgacagggagatgtggcgcaatatcggcaacctgaccgcctccagggaggagtcttggcacctgatgccagatgtgctgcgccccatcaagaagagcgccgacgccacagattactatgagaatatctcctctctggccatgatcccaatgacccagaacgccggctacagcgccatgttctatgacgatacagtgcagatccccaaggagtacctggaggattcctacctgggcgagtatctgaccacaaggatggagatcgtggaggagatctctaagatgtgggacaagctgaagatcagcgccctgctggacaataaggataagttttccggccactacagggacgatgccctgcaggagtattgggtgaagatccaccagtttctgttcgacggcgacgattctttcctgaaccacgtgatcagaatgtaccacgaggatagctcctcttttgagaagaccgccgacaaggccctgttcgagtatctgacaaagagcgtgaaggagatctgcgagaaggaggagaagaataccaactcctggaatatgctggtgaagatcatccgccagatccacggcaagaacggctgtctgcacatcttctacggcaccctgaagaagtattggaagaaggagggcaaggacaagaacgatacaggcagcatctga

SEQ ID NO: 1254 - DNA, 5565 bp, Klebsiella pneumoniae strain VRCO0172
atgggccccaagaagaagagaaaggtaggctctggcatgaccacacccttccgcaacacccggatcgagtttcacatcctgcagagcttccctgtgacatgcctgaatagagacgatgtgggagcaccaaagtctgccatcgtgggaggcgtgagccgggccagagtgagctcccagtgttggaagagacaggtgaggctggccctgcctgactttggcatcagactgggcgtgaggtctaagaagaccgccagcctgctggcaaacgcctgccgggccctgggagccagcgaggagcaggccaccggctgtggcgaggccatggccgccttcttttctgacgatacactgctgtttctgagcgaggcagaggcagcagccttcgccgcctacgcccagggcaaggattttgacgccgccagcctgaaggacaaggagctggtgaaggtggccaagaaggtggtgaacaataccctggatgccctggacatcgccctgttcggcagaatggtggccaaggcagcagatatgaacgtggaggcagcagcctcctttgcccacgcaatctccacacacaaggtgtctaatgagatcgagttctttaccgccgtggacgattgcaagacagaggacgagtccggctctgcccacatgggcagcctggagttcaactccgccacctactatagatacgtgtccctggatctgggacagctggcacagaccctgggagaggatgccgacatgaagacagccgtggccgcctttgtgaaggccctgtacgtggcagtgccatccgccagacagaccacacagtctggcgcctgtccttgggagtatgcccgcgtgctgctgcggaagggacagggactgcaggccagcttcgagcagcctgtgaagtcccagggcgagggctttctgagcccatccaaggccgccctgaagaattggctgcacaccaaggagaagctgtctggcagcctgttcggcaagcagggcgactacgagtggggcgaggatctggactatagcatcgatcgcctgatcgcagacctgcagtcccacctgggctctggcgagggaaggggctccctgctgacctgcggcgatgtggaggagaaccctggacctccgaaaaaaaagcggaaagtgggcagcggcatggatcaggtgcctgcagacgtgacagcagagtctgccggcaatgagagcccagccaagcggttcgtgggctatgtgatcgagcggatcgccaaggataacggatttgcagcacgcctgaagagggcagacaatccagccaccgagtatcagtcctgggagatcctggccggcttcggcatcgacctggagaaggagtggcagcgcctgccatactgcgtgatcggagccgccctggcaaaggcaaagcctgcctctaacggaaccatcacactgggagcagcaatcgcaggatgttaccccgagggcaatcagagcgagcaggcaaaggcaaggctgcggagactgctggcatgcacctccacatctgaggcctgtagaatcctgaggccactgctggccctgatggcaagccgctccgtgacccccgacttcgcaggactgctgaacgagctgcagtggtttagcggctctagcagggagcgcatccgggcaagatgggcacaggagttttataggagggcaggagaggcagcaggctctgaggccagaaacagccacgacggctccggcgagggaaggggcagcctgctgacatgtggcgatgtggaggagaaccctggacctccaaagaagaaaagaaaagtcggcagcggcatgaggcagaccacacagtacatgctgctgtggctggagggaccactgcagtcctggggaggcgactctaagtttggcgtgagagataccctgaatttccctacaaggtccggcatcctgggcctgatctgctgtgcaaggggagcagcaggccctgaggtggagtggctggccgagatgaacaatctgccaatggaggtgagagcctatgccaggaccgacaaggagggacagcctctgctgagggagccaacactgtgcgatttccagatggtgggcagcggctacgacgattccgacccctggcagtctctgctgatccctaagaccagcgatggcaagaaggcagtgggaggaggaaccaagatgacatacaggcactatctgcaggatgccgtgtttgcagtggtcatgggactgggcagccagcaggcagagtccctgcctgaggccctgcagaacccagtgtgggacctgtacctgggccggaagtcttgcgtgcctagcgagctgatctaccagggcatctatgattccgccgaggcagcatggcagcaggcaagaaccctggccgagagcaagcggagaacactgtcctataaagtgatcgagggcgagggcgatggcgacgtgatcaccctgaacgacgtgcctgtgcagttcggccgccacaagaggtaccgcgataggcaggtcaccgtgctggagtgcggaggctctggcgaaggcagaggcagcctgctgacctgtggcgacgtggaggagaatccaggaccccctaaaaagaaacgaaaggtaggctccggcatgaccgatctgtttgcatctgccctgcacctggacagggcagcagtgaaggccctgaagatctccgatgcctactctctgcaccgggtggtgtatagcctgttcgcagatgcaaggacagacagggagaagtgctcccacatctcctctggcatcgcatacgcagatcagggaggcgactttcacggacgcaagatcctgatcgtgagcgacaggctgccagcagcaaaggtggatggactgtacggcgaagtgatctctaagagcatccctgccgcctttctgtcccacagccggtataggttccaggtgcaagtgaatccagtgaggaaggacaagcagaccggcaagagagtggccgtgaagggcagggccgatatcgcacagtggttcatccagagggcagcatcccggtggggctttgatgtggacctgccaggactgcaggtggaggcaatggaggtgctgcagttcaaggacaagggaggccgccaggtgaccctgggcaaggcaacagtgcagggactgctgaccgtgacagatagacagaagtttcagcactctttccaccacggaatcggcaagggaagggccttcggctgcggactgctgcagatcgtgccagtggtggacgccctgtttagcggctccggcgaaggcaggggcagcctgctgacttgcggcgatgtggaagaaaaccctggacctcccaagaaaaagaggaaagtgggtggctctcagctggtgaagagcgagctggaggagaagaagtccgagctgcgccacaagctgaagtacgtgccacacgagtatatcgagctgatcgagatcgcccgcaatcccacacaggacagaatcctggagatgaaagtgatggagttctttatgaaggtgtacggctatagaggagagcacctgggaggctccaggaagccagatggagccatctacaccgtgggctctcccatcgattatggcgtgatcgtggacacaaaggcctacagcggcggctataacctgccaatcggacaggcagacgagatgcagcggtacgtggaggagaaccagacccggaataagcacatcaacccaaatgagtggtggaaggtgtatcccagctccgtgacagagttcaagtttctgttcgtgtccggccacttcaagggcaactacaaggcccagctgaccaggctgaatcacatcacaaactgcaatggcgccgtgctgtctgtggaggagctgctgatcggcggcgagatgatcaaggccggcaccctgacactggaggaggtgaggcgcaagtttaacaatggcgagatcaacttctctgctagcgagacacctggcacctccgagtctgccaccccagagtccggcggctctggctctagcggcggctctggctcctccggaggaatggagaacaggttcaatctgatcgacgagccctggatcgccgtggtggatgtgggcctggtgtccctgaccgacatcttttctcagccagagctgcgcgccctgggaggaaatcctgtggagaagatcgccctgacaaagctgctgctggcaatcgcacaggcagcagcaacccctacagacgattccgactggcagcagatgggatggcagggaatggcacactgctgtctgcagtacctggccaagtggcacgatcggttctacctgtatggcgagaagcccttcctgcagatgcctgccatccaggcagcagagtgcaagtccctgggcgtgctgagccctgaggtgtccaccggcaacaccacagtgctgacagagtctcagcagcagcagcagctgaccgatgccgacaaggccctggccatcgtgatgcagatgggcttcggcctgggcggcaagaagaccgacaacagcgtggtgctgacacccggctatcggggcaagcagaatgataagggcaagcctggcagcggcaaggcaggcgtgtccgtgggacacatgggcctgctgcactccttctggcagggcaactctatcgtgcagagcatctggctgaatctgtttaccgccgaggacatcacacagctggccatgtacccaaccctgggcacagccccatgggagagaatgcccaccggcgaggacgatgacatcgccagatccctgaaggcctctctgctgggcaggctgatcctgatgggcaagttctgtctgctggccgaggatggcatccactacagcgacggcatctcccacgccggctatctggagggcaagaccgatcccagcgtgtccgtggacttcagcggcaagaagcctaaggccctgtgggtgaatccaggcaagagaccctggagggagctgacatctctgctgcagtttatcgagcaggacagcccacgcggctatgagacccggcagctgagcctgcccctgaagagaatcacacaccacgcagagcagtttgcactgtggtccggcggactgagggtgagctccaacgcaggagagcagtacgccagcggcaccgatgactatgtgcagtccgagatctggctgtctagcgacctgatcaatcacaccttcctggagtacctgaagtatgagatgacacagctggatgcagtgcagaagcagctgtggggagcagtggtgcgctactttcggcagctgtccgatatcgacaagtctgccacaggcaaggcacagcccttcgtggcaaagcaggcagagaaggccaccacaatcttttggcagctgtgcgagaggcaggcacagaccctgatcaacgcctgtctgaatagcggcgaggaccacacagccagactgcagctgaggaagatctttgccagatatgccggccaggtgttcgatcagctgtgccctgccgactccgccaggcagctggatgcctgggcactggcccggccaaacttctctcagtacctgaccctggattga

SEQ ID NO: 1255 - DNA, 5769 bp, Streptococcus thermophilus strain ND07
atgggccccaagaagaagagaaaggtaggcagcggcatgaccacagagcagagactgtttctggacatccacgccatccagagcctgcccccttccaacatgaatcgggacgataccggctcccctaagacagcccagtatggcggcgtgcggagatctagggtgagctcccaggcctggaagaaggccatgcgcgagtacttcaacacccacggcgatcacagcaatgtgggcatcaggacaaaggagatcgtgcgctatgtggccgacaagatcgtggagctggattctagcatctccatcgaggacgccctggagaaggccgataaggtgctgatcgccgccggcatcaagaagaagggcgaggtgaaggccctgtacttcatgggcgattcccaggccaagaagctggcacaggcagcatacgacaacatcacccacaagaaggagctgcagaagctggccaatgaggaccccgccatcgatatcgccctgttcggaaggatggtggcagaggaccctaccctgaacgaggattcctctagccaggtggcacacgcaatcagcacccacccagtgcagacagagtttgatttctttaccgcagtggacgatctggcccccgaggacaatgcaggagcaggaatgctgggaaccgtggagttcaactcctctacactgtaccggtatgccaatgtggccatccacgagctgtctaagcagctgggcaacaaggagagcctggagaattctctgagcctgtttatcgaggccttcgccaagtccctgcctaccggcaaggtgaacacatttgccaatcagacactgccacagaccctgatcgtgacagtgaggtccgaccgcccagtgaacctggtgtctgccttcgaggagcccgtgaagagcatcgagggctatgtgaccaagtccatcgataagctggccaaggagtttatcaaggtggagaagttcgtggacaagcccctgatgaccttttacgtgacactgcacgagtccgattctctgaagcagatcggcgaggagaaggatagcgtgtccaagctgctggaggacttcagcgagatgatcgcacagtacatcggctctggcgagggaaggggcagcctgctgacctgcggcgacgtggaggagaaccctggacctccgaaaaaaaagcggaaagtgggctccggcatgtctcagcacaccaagcagacagtgtggaccgtgacaaagaagatcatcttcaagctgtccaatcagaaggaggagacctacgataaggccacactggccaaggtgcgcaagaccctgggcaagcctctgtctgaggccacagagatctggcctatcctgtttgagaacctgccagaggagttcctgagctcctaccagcagccatcctatgaggagctggccatctacaccgccctgcagctgtatgccctgcaccagcagggcgtgtctacaagcgtgatgctggacgattctaagccttatgagaacatcggcagcgccctgggcaagctgcgcaaggaggacgataccacaagcatcgacaggcgctttaataccatgatcacatctagcaccttcgaggagctgacctaccacctgcggcacctgatctccctgctgaaggtggagtctccagtgatccaggtggactactccggcctggccaacgatctgtattggttcctgaacaattctcaggagaacgtgaggctgaattgggcccgcgcctactataagcagatcaagggcgagaagaacaatgacaacggcagcggcgagggaaggggctccctgctgacctgtggcgatgtggaggagaaccctggacctccaaagaagaaaagaaaagtcggcagcggcatgaagaccatcctgctgaagtttgcaggacctctgcagtcctggggcacatcctctcactttgagacaagacacaccgacttctatccatccaagtctgccgtgatcggactgctggcagccagcctgggataccggagagacgaggatgagaagatccagaagctgaatgagctggacttcgccgtgcgggtggatcagcagggcaacctgctgagagactttcacgtggcccagaagtacaccgagaagggcaagttcgatcggaactatgtgacaaatagatactatctggaggacgccgtgtttgtggtggccctgtcccacaccgacgattctttcatcgatatcatcaagggcgccctgaagaacccctactttcagcctttcatgggcaggcgcgccctgcctatcaccgcagactttatcctgggcgagacagatgtgaatccactggagagcctgaagtccctgaagtggcaggcctctctgtggttcatgaagaagagccacgacaaggatgccatctccctggaggtgtacctggactctcagctggtgaacaaggacgtgtaccagctgcggcaggactacgtgcggagcttcagccagaagggccggagattcggctttaggtacgaggtgcgcgagctgatctccgtgcagaaccctcactatctgaacaagaataccgagcacaatatcttcgagagcatcggcgacggctccggcgaaggcaggggcagcctgctgacatgcggcgatgtggaggagaaccctggacctcctaaaaagaaacgaaaggtaggctctggcatgtacatcagcagggtggagatcgatcgctataataggaggaaggtgcgcgacctgacccacgtgggagcatatcacgcctgggtggaggagtcttttccaagcgagctggagcagtctatcaggacacgcaagctgtggcggatcgacagaatccagggcaaggattacctgatcatcgtgagcaaggagaagcccaatctgcagaagctggagaagtacggagtggtgggcagcgcccagactaaggactatcagcacttcctggattccatcaagacaggctttcggatgaacttcagaatcgtgctgaatcccgtgatctccatcacctctcctgacaagagcaagcggggcgtggtgaagccccacgtgacaatcaagcaccagatggattttctggtgaagcagtctgagaagaacggctttagcctggtgggcgagtctttcagcatcgtggagaggggctatgaggtgttccagaagcctgagaagccaatccgcctgtctaaggtggtgtacgagggcaccctgacagtgagcgacgataccctgtttaagaagatgctgacagagggcgtgggcaagaagaaggcctacggcttcggcctgatgaccgtggtgcccctggaggagggctccggcgagggcaggggctctctgctgacatgtggcgacgtggaagagaaccctggacctcccaagaaaaagaggaaagtgggtggctcccagctggtgaagtctgagctggaggagaagaagtccgagctgcggcacaagctgaagtacgtgccccacgagtatatcgagctgatcgagatcgccaggaaccctacccaggaccgcatcctggagatgaaagtgatggagttctttatgaaggtgtacggctataggggagagcacctgggaggcagccggaagcctgatggagccatctacaccgtgggcagcccaatcgactatggcgtgatcgtggatacaaaggcctacagcggcggctataacctgcccatcggccaggccgacgagatgcagaggtacgtggaggagaaccagacccgcaataagcacatcaaccctaatgagtggtggaaggtgtatccaagctccgtgacagagttcaagtttctgttcgtgtctggccacttcaagggcaactacaaggcccagctgaccagactgaatcacatcacaaactgtaatggagccgtgctgagcgtggaggagctgctgatcggcggcgagatgatcaaggcaggcaccctgacactggaggaggtgcggagaaagtttaacaatggcgagatcaacttctctgctagcgagacacctggcacctccgagtctgccaccccagagtccggcggctctggctctagcggcggctctggctcctccggaggaatgtccaggttcaacctgctggatgagccatggatctccgtgatctatgacgagaagggcagcaccaaggacgtgtccctgcaggatctgtttacaaatgcccaccagtacaaggagctggccggcgacaccaagacacaggatttcgccgtgctgcgggtgctgctggccgtgctgcacaccgtgtttagcagattcgacatcgatggcaacgcctacgagtatctgacaatcgacgagggctggaatcagctggagcctgtggacgagatggatatcgagaactacgaggaggccctgtatgagacctgggagaagctgtggacaaataagcggttcccaaacatcgtgaatcagtacctggagaagtggcgggaccggttctacctgttcgatcagaagtatcccttctttcaggtgaccaaggaggacatcgccggcgataagatcagcaaggccaagggcacatccatcctgggcaagaacatcaatagaatcatctctgagagcggcaacaagatcgccctgttctccccaaaggacgaggagaacaagaataccctgacagcagcagagctggcaaggtggctgatcacctttcagggctactctggcgtgagcgacaaagtgatcttcggcaacgagaagtatacacccagcaagggctggctgtttgatatcggcgccatctacatcaagggcaataccctgttcgagacactgctgctgaactacatctccccatataatgagtgcggcaacgtggagaatatccagcggccctgttgggagagaaagagctccgatatcatcaagtcttacctggacgagaaggatatcaccaatatcgcctctctgtacacagtgtggagcaagggcatctatatcgaccccgacttcaacctgaataagcccttttccttcgacatcgtgaagctgccagacatcaaccacagggataatttcctggagcccatgaccctgtggaagtacaacgtgtccggcaagaatcgcgattcttatacacccaagaagcacctgctgaaccagtctctgtggaggagctttggcctgctgagcatcaaggacaccgatctgcagcaccgcaagcctggcgtgatcgagtggctgacatacatcgacgatatcatcggcaaccggctgagcaatatcgtggccatctccatgcaggacgatggcaatccacagagcagactgcccaccgacgaagtgatcgattccatcttcatcaacgacctggtgctgacagacctggatgagggcggctgggtgcccagaatcaatgaggtggtggaggagaccaagaagatcatctcccggacatacaagacctatatcaacgatatcaaggagatcagaaacatctccaatggctcttacacccagcagatcgtggagagcctgtacttcaagatcgaccagcccttcagacagtggctggcctccatccagcctgaggacgataaggattctaagatccaggagtggagggtgctgctgaagaagatcgtgaaggccgaggcagaagtgatcctgcaccagggaggagccagggattatctgggcatccagaaggacggccgcatcaagaacatcgccaccgcctacaatagctttgacttctggctgaggcagcagctgaagtga

SEQ ID NO: 1256 - DNA, 6294 bp, Streptomyces sp. S4
atgggccccaagaagaagagaaaggtaggcagcggcatgtcccagccagcagcaaggccacctagaacatacgtggactttcacatcctgcagaccgtgccacccgccaacctgaatcgggacgatcagggcaacccaaaggaggcctactatggcggcgtgcggagatccagagtgagctcccaggcctggaagagggcaacccgcacacacttcgcagagcgggtgcccgagcaggatctggcaaccagaacaaggaggatcatcggcgccctggcagacgatatccagaagagggccggcctggataggcctgccgccctgaggctggcagacgccctgctggccccactggagctgtccggcggcaagaagaaggacgagtctgcctacctgctgttttatggccggagacagctggatgcagtggccgccctggtggcagaccaggcaaccgagctgtctgccctgagcgatgcagacctggcatcccgggtgaaggagctgcccgtgagagagcagttttctacaggccaccctatcgacgtggccctgttcggcaggatggtggccgacatccctgccctgaaggtggatgcagcagcacaggtggcacacgccctgagcacacacgccgtggagctggagtttgattacttcaccgccgtggacgatgagcagacagacgaggagaccggagcaggaatgatcggaaccatcggcttcaacagcgccacactgtaccgctatgcctccgtgggactgcaccagctgctggacaatctgaccgatgaggaggccgccctgacagccatctccgagtttgccacctccttcgcccggtctatgcccacaggctatcagaactcttttgcccacaggaccctgcccagcctggtggcagtggtggtgcgcgaggaccagcctgtgaatctggtgagcgccttcgagcagccagtggccacaccatccggcatcgcagcagcatctgccgcaaggctggccgaggagcacacccgcgcaaccgtgacatggggcgatgcaccagcctttgccgcagcaacacacgtgttcaccgaccaccagaagaccacagccgccctgaacagcgcctttggccctagcatcccattctccgccctgctggagggactgcacacccacctggcaggcgccctgaagcctaagcaggcagcacagggcagcggcgagggaaggggctccctgctgacctgcggcgacgtggaggagaaccctggacctccgaaaaaaaagcggaaagtgggctccggcatgtccacatctccactgtctgcccccgtgcctggccagagagtgtctagcctgccaaggccatactggtccggcagggcagatgagcagggacagtggcggaccagagcaggagagagcctgaggccacctggagaggacctgtccgccctgagagcaggactgggcaagaaggccttcacagagccaaggctgtggcagtactataccacacccacagatggccgcgtgaccctggagctggaggcagagcacgccgccctggccctgtacggactgcaccagcagagccaggagcagccaatgcacaggcagggcgtgcggaccggaagagccctgagggccctgcaccagcggtactctgaggaggcaacagacaggcgcgtggcacaggcagtgggagccaccagcgccgcagcctttgcctataggctgcgcgccctggtgacccagctgaggtctatcggccagccactggattacgaccagctgatgcaggatctgctgaggtggcacttccccgacggccggagcagagtgcggagaggatggggactgggataccacggaagggacaggcagcccgatgaggccccaccccctgagggcagcggctccggcgaaggcagaggctccctgctgacttgtggcgacgtggaagagaaccctggacctccaaagaagaaaagaaaagtcggctctggcatgaccacagcacctacaccagagccagcaggaaatacccacccagcacacggctccgatgagcctaccgtgctgctgctgaggctggcaggaccactgcagtcttggggcgtgagatcctcttttaacaggagggacacaggagcagagccaaccaagtccggcgtgatcggactgctggcagcagcagcaggacaccctagagagcagccactgggagagctggcagatctgaccctgggcatcagggtggaccagccaggcacactgctgagggactaccacaccgtgagcgattataggggcagacctctgccacaggcaggcgtgtctgccaagggcatccagaagcccaccagccctgccaagcacacacacgtgaccacaaggttttacctgcaggatgccgtgttcgtggccgccctggagggacctccaggactgctgaccacactggacagggccgtgcggaatccagcattcccactggccctgggccggagaagctgtccacctacccagccactgtccctgggactgcggaccacagatatggagacagccctgagatctgagccttggcaggccagcgcccacaccagagagcagtatgcaaggcgcctgggaagggagaggggactgcaccagcctctgcacccaggaaccatcgacagggcagcaacaatcgaggaccccaggggcgacgataggctgcaggacgcacccgtgagctttgatcctcaccagagggccttcacctccagacaggtgaggcacacctggctggccatccccacaggctttgaccacatcgacgatgaccagcctcacggacaggcagatgaccccgatcacgaccctttcgccctgctgggatggggctccggcgagggcaggggctctctgctgacctgcggcgatgtggaggagaaccctggacctcctaaaaagaaacgaaaggtaggcagcggcatgacatacctgtcccggatcagaatcaacccactgcggaaggacagccggaagctgctgagcaatccaagggcagtgcacggagccgtgatgggaggcctgccaaaccacaagcccgatgacagggtgctgtggcgcatggaccccgacaatcctcacaggccacacctgtttgtgctgagccccacacgccctgactggacccacatcatccaggattgtggctggccagatgcagacggcgatcacgcagccgtgagagactataccccactgctgagccagctggcagtgggaagagagttcgcctttaggctgacagcctcccccgtgcagaacaccgccacaccaaccaaggcaaccccagcacaggcagcaaggctgaccacacacgccgagaatggcaagcggatcagaggcttcagaatgggacacagaaccgcagcagcacagctggattggtttctgacacgcaccgaccggtggggcttcgatatccctgcaacaagatctgacccagcagcaccaggcatccacgcaccaacacctccaaccgcaccaaggcctacaagcccacctagaccagatcccaacccaccatacgaggtgcgcatcaccgcaaggcacagacactcctttcagaagaatggccacggcgcccacgtggtgtttcggtctgccaccttcgagggcaggctgcgcatcacagacaccgatcggttcaccacatctctgctgacaggcctgggccctagcagagcctatggatgcggactgctgacactggcacctctgccaggacagcagaccggctctggcgagggaaggggcagcctgctgacctgtggcgacgtggaggagaaccctggacctcccaagaaaaagaggaaagtgggtggctcccagctggtgaagtctgagctggaggagaagaagtccgagctgaggcacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagccagacggcgccatctacacagtgggctcccccatcgactatggcgtgatcgtggataccaaggcctacagcggcggctataacctgccaatcggacaggcagacgagatgcagcggtatgtggaggagaaccagaccagaaataagcacatcaacccaaatgagtggtggaaggtgtaccccagctccgtgacagagttcaagtttctgttcgtgtccggccacttcaagggcaactataaggcccagctgacccggctgaatcacatcacaaactgcaatggcgccgtgctgtctgtggaggagctgctgatcggcggcgagatgatcaaggcaggcacactgaccctggaggaggtgcggagaaagtttaacaatggcgagatcaatttctctgctagcgagacacctggcacctccgagtctgccaccccagagtccggcggctctggctctagcggcggctctggctcctccggaggaatgcctggcaagggaggagcaagcgtgaacctgctgtccgatggctggctgagcgccgtgtccgccggcggcggcagcggctttggaggaggacctggagcaggaccagcagagttcggcgtgcgcgagctgctgctgaatgccgagaagtttgccgacatcgtggtggatctgccaacccagaggcctgccgtgttccggcaggtgctgctgcctctggtggtggacgccctgggatgtccaaaggacgcagaggcctggatggatatgtttagggcaggagccttctcccccgagcagaggcaggtgctggccgactacctggataagcaccagcacctgtttggactgctggaccccgtggagccattcggccaggtggccgacctgagaacagcaaagggagagaccaagggcagcgccctgctggtggcaacagcagccaccggcaacaatgtgcccctgtttagctcccggacagagggcgacgtgctggagctgacccctgcagaggcagcaagatggctgctgcacacacactgctgggataccgcagccatcaagacaggagcagtgggcgaccctatggtgaagagcggcaagaccaccggaaacccaacaggacctctgggacagctgggagtgaccatgccagtgggctccacactgttcgagaccctgctgctgaatatcccatacggacaggcaggactgtctgatgacgtgccacagtggaggcgccggagcacccagggcgacgtgaaggataccctgtcctgtgcaacacccgtgtggcagagccggccagcaaggggactgctggaggcctggacatggcaggccagaaggatcagactgatctcccaggacacagatcgcggcccaaggatcaccagagtgctggtggcagcaggcgacaggctggaggtgtctccagatacagagccccacaccgcatgggtggtggatagcccagcaggccggagaggcaagtctcctgcacggagcggcgtgaagtccgccagaccaagaaggcacaccgcaggaagggcaggatggaggggcctggacgccctgctggccgtgaacgccgtggaccaggatcagcaggcaacagcaacccggagcggcgccgtgtctagccagctggtgagacagctgtctgccatcagccgccggctgcctagccggtacccactgagagtggagctgaccggcatcgcctatggcaaccagtccgccgtgatcgaggacatgtacttcgatgagatcccactgcctgtggccgccctggaccccgagggcatcgtgtacggcgccctgctggaggtggtggaccaggccgaggatctggccaaggccgtgaatcacctgtccggcgacctgagaagggcagcaggctctgagccaatcccatgggacaagggacagaggcctggcgataccctgctgcacgccctggacccaatcgtgcgccggctgctggcaggactgaggcaggccggcgatgactttgataggtgtgagcagggcctggaggcctgggagcacaaggcaggacaggccacactgcgggtggcagagggcctgtttaatagcgccccagccgccctgttcaccggcagaagggtgaagaaggacggcaaggagcaggtgtatcgcctgtctacagcagaggccagcttccgccggagactggccgtgatcctgcacaggcgcgccgccgcccggaccgccggctga

SEQ ID NO: 1257 - DNA, 5103 bp, Campylobacter fetus subsp. testudinum Sp3
atgggccccaagaagaagagaaaggtaggctctggcatgaagctggccaaccgcatctacggcatcatcggcatcaagagcaccatggccaattggaacgccgacttttctggccgccccaagagcacaggcaatggcgacatcttcgccagcgataaggccctgaagtatcctatgaagaagatgtgggagtcctacggcaagaacatcctgttcgtgaagtccctgaagcagggcaagtctaaggacggcaacgataagctggtgccaaataccctgggcgagcggtatggcctgctgtttggcgatatcaagaaggccaagagcacaaaggaggtgctgtccaatctgttcaactgcatcgatgtgaagaattttggcgccaccttcccagaggacggctacaacctgagcatcacaggcgccgtgcagatcggccagggctttaacaagttcggcgacatcaacatcgaggtgcagaatatcctgtcccccttcgccgatagccgggccaaggagaagaatgagaacggagaggacgcctcccagtctaccctgggcacaaagatcgtgaccgatgaggcccactacttttatggcttctgtatcaaccccctggcctataatgactacaaggagatcctgggcgacgattttggctataatgaggacgattacgccgagttcaagaaggccgccagattctgcgccacctactttaatagcaactccaagtttggctgtgagaacgagtttgccatgttcatcgagacagccgtggacgcctatctgcctgatctgagctcctacatggacttcatctgcaaggataagaacaggctggtgaatctggagaagatcgagaagatgatcgagtctagcgatgtgaagaaggtggagatctactataatcctctgtccctggacgtggagaccaagtttgacaagttcgatatctattctggcaacaagatcggcagcggcgagggaaggggctccctgctgacatgtggcgacgtggaggagaaccctggacctcctaaaaagaaacgaaaggtaggcagcggcatggatgtgaagatctaccagctgaaggtgttcctgaagctgaatcagaacgtggacttcatcaacagcccagagtttctgtccaccaatctgcacaaggccatgctgggcgatgaggccctgaggtccatccacatgcagcggtacctgaagccctactctatcggctttctgtacagcatgaagggcaagaaggacacatttgtgagcggcgaggatatgtacttctatgtgcggtccatcgacgagtctttcatcagcaagctgagaatctgcctggagaattctaagaacctgggctttaacgtgtatctgagcaagttcgagaatctggacatcaagcaggtggataggctgtacaccatgagccctgccacaatcgtgctgaaggagggcgataagaccatcccatggcggagagagaactccgacatcacagtgctgaaggaggccctgatctctaatctgaagaacaagtacgagtatttcctggacaagaagatcgagatcaaggacgatatcatcgagctgatcgagatcaagaccaatcgggccttcgcctttagatataagaacggcaagatctacgcctataggtaccagatccactttagccagaaccgcctggcccaggagttcgccaatatcgccatgatcctgggcgtgggcgtgaagaataccctgggcttcggcttttgcatgaggtccaacaatgcagtgggctctggcgagggaaggggcagcctgctgacctgcggcgatgtggaggagaaccctggacctccaaagaagaaaagaaaagtcggctccggcatgaaggccatcagctttaagctgtccggcaagtttgcccacttcaagaagccagacgtgaacgagtacgtgtacttcacctacaacaatatccccaagcctacactgctgggactgctgggagcaatcatcggcctgaagggctatgcccagaagacctacaacaataagaaggacaagaagagcctgctgaacaatgagaatcggtccaacgagcctgagttctatgagagactgaagcacctgaagatctgcatcatcccactggtgaagtacggcaagttttctaagaagatccaggtgttcaacaattctgtgggatatgccagcaccgaggagggaggaaatctgatcgtgagggagcagtggctggagaaccccagctggcagatcctgatcgaggacgatggctctgccgagtttgagacaatcagccagtatctgttcgataagaaggccaagtttatcccttacctgggcaagaatgaccacttcgccgatatctccgaggtggagaagatcgacctggccgagtccaagaaggataagatcgtgatcaagtctctgttcctggacaacctggccaagcaggtggacgatcccgacgatgagatctcttatctgtttaacgagttctaccctatcggcttcaatgagctgatgttttacaagctggagaagaccaccttcaccaatcagatctgtcaggccatggatggcaagtggtatgagttcaaggacggcaccatctgcttctttggctccggcgaaggcaggggctctctgctgacatgtggcgatgtggaagaaaaccctggacctcccaagaaaaagaggaaagtgggcggctcccagctggtgaagtctgagctggaggagaagaagagcgagctgaggcacaagctgaagtatgtgccacacgagtatattgagctgatcgagatcgcccggaatcccacccaggatagaatcctggagatgaaagtgatggagttctttatgaaggtgtatggctacaggggcgagcacctgggaggctctcgcaagccagacggagccatctataccgtgggcagccctatcgactacggcgtgatcgtggatacaaaggcctattccggcggctacaacctgcctatcggccaggccgacgagatgcagcggtacgtggaggagaaccagaccagaaataagcacatcaatccaaacgagtggtggaaggtgtatccctcctctgtgacagagttcaagtttctgttcgtgtccggccacttcaagggcaattacaaggcccagctgacccggctgaaccacatcacaaattgcaacggcgccgtgctgtctgtggaggagctgctgatcggcggcgagatgatcaaggccggcaccctgacactggaggaggtgaggcgcaagtttaacaatggcgagatcaacttctctgctagcgagacacctggcacctccgagtctgccaccccagagtccggcggctctggctctagcggcggctctggctcctccggaggaatgctgttcgagctgctggatgagtttaagaagcagctggagaagaacaagcacatcgtgacacagaatcacatcctgaaggatggcgtgtatgcccgcatctccgacgagaagtgtgagatcttctacgtgaagaccatcacagagaagatcggcaagaccgcccagaagcggacaatcctgtataagcagaacggcgacatcgccctgaatgacgatatgcagtggtttgagcaggccgactacctgagcttcctgtgggatatgaacaaggccgtgctgcccaataagaagttccacagcatcaactttctgtccctgttctttaagctggaggagtccgagtacgtgaaggagaatctggaggagtattttgacatcttcagagattactccgcctttaacaaggccaaggataaggagatcctgtctttctatatggactacatcaaggatgagaataggcagaacctgatcaccaattctgtggtgctgagcaagaagtacttcaatgacatcaacgattttgccgtgcagaacaatttcaagaagtgctacatcaagttctttatcgacaaggatttcgagatctacgagaaggagagccagatctatatcgacctgaagatctacaattccaacgagcacaacatcaagtataacaatgagatcttcggcctgtctaacttcaacatgggcatgaatagcaagaagccatttctggagcacaagaaccgcctgttcaagatcccctacgccatctcccagaaggatgccctggcctctaagatgctgtttgactggctgggcagccagaacaagcggatcatcagagactttaattccatcttcatctctaagtttaacaagcagtctaaggccgtggtgagcgacttcgagtacgtgcccgtggataagaacaagtttaagttcgacaagttcaagctgaagaacttcatgaacatcgagaatggcgagaaggagatcctgagctttgacgatttcaagcaggtcatcgatgagcagctgtatcacaagtgcctgtttggcaacctgtacaatgatgagatcagggtgagcaagcgcatctccgaggacatgcagaatctgctgtatcagacccggtgttccatggtggagtactttgacaagttcaacaataacgagttctactatgtgatccagaagtactctaacgacttcatcaagatcgccatgcaggacagcgagttcggccgcctgaacggcaagaagagcatcaatctgctgctgtccatcaaggagatcaagggcgagaaggtggacatcgatggcatcaagaatagagtgatctccgccctgaccgacgataacgtgacaaagctgtctggcaatgagtactattttctggtgggcaacctggccatgtacctggtgagcaagtccaagacctggaagaagacattcgccctgaccgatccatatacaaaggcccggaacaccaagaagctgaagatggccctgtttatcgacttcgatagatataactacgacatctttctggagaatggcatcctgaagaaggccttcagcctggcccagaattgtgaggatatcgtgatgtccaataacgaccagcagatggtgctgatcggcatgatgacaaagaacatcatcaagaagcccggcgagaaggacgagatcagcgagtga

SEQ ID NO: 1258 - DNA, 5319 bp, Odoribacter splanchnicus DSM 20712
atgggccccaagaagaagagaaaggtaggctccggcatgtctaacaccttcaagaatcgggtgtttggctgcgtggtcatcaagagcgtgaactccaattataacgccgacttctcccaccagccacgcacactgcctgacggcagcgtgtacgccaccgataaggccctgaagtacacagtgcggaactatatcgacaagaattaccctgaggataaggtgttctactttaagtctctgaacggcgacatgcagccacgcgacctggatcagaattatgcccggttctttggcgactaccccaaggccgataagaaggaggccgtgaaggccagaaaagtgatcctgggcaacctgctgagctgtctggatgtgaggctgtttggcggcaccttcgcctctaagacagccaacctgagcatccacggagtggtgcagcctacccacggagtgaatagatatgtggagggcatcatctacagcgagcagatcgcctccccattcaggaattctaacgacaattctaccgatagcatgcagaccacactgggcacacagttcaagctgcaggagggccactacgtgcaccactttagcgtgaacccaggcaatctggacgagctgaccgagtttgtggataacggccgcctgacaggcgaggacatcgcaaagctgaaggaggccctgagatgcggagtgacctactatgatagctcctctaaggccggcacagagaacgaggccctgctgtgggtggagctgaaggaggagtccaagctggtgctgccctctttcgtggacctgatcgaagtgaatgccgagcgggagatcgattttgccaaggtgtctaccctgctgagcaaggagaagatcaagaacgagatctccaagatcgagctgttctacaataagggcatcaccaaagtgatccacctgcctgagggcacagtggagctggagctgaacggactgggcagcggcgagggaagaggctccctgctgacctgtggcgacgtggaggagaaccctggacctcctaaaaagaaacgaaaggtaggcagcggcatgaggctgaagctggtgctgaagatcgtggagggcacagtgctgccctgcaactatatgtacgagctgagctcctgtctgtacaaggtgctgaacgagggcaatcccgtgttcaccgcctggctgcacgataagggctattgcaaggagaagaaggcctttaagctgttcacattttccaatttctactttccatgtttcagaatcgagggcgacaggatctttgtgctggccgataccgcccagctgatcgtgtctttctaccccatcgaggccatcgacgccttcgtgatgggcctgtttaagaaccgccagctggaagtgggcgatcggaagtccagggtgcgctttgaggtgttcaatctggagaggcaggcagagcctgagttcaccagccggatgttctttaagacactgtccccaatgtttatcgaggagcagctgcccgagacaagaaaggccatccacctgtctcctggcaacccaaagttcgccgagctgctgcacctgaatctgctggacaagtacagagtgttttatggccaggagcccgatcctagctggccactgaccaggctgcacctgctgtccgagccaaagcccaagacaatcgtgctgaaggtcggcacccccgaggagacaagaatgaagggctataccttcaggtttgagctggagggccagcctgagctgctgagactgggatacgagggaggattcggcaggctgaacagccagggctttggctgcgtggaggtgctgaagcagggctctggcgagggaaggggcagcctgctgacatgcggcgacgtggaagagaaccctggacctccaaagaagaaaagaaaagtcggctccggcatgaacaatcagcggctgatctctttcgacatccaggccgattttggcttctttaagaagcctgactataacgatggcgtgctgctgacctacaatatgctgcacaagccagccctgctgggcatcctgggagccatcatcggcctgagaggctacaggaagaagggcgagtggcccgagtactatcagagactggccgccctgcctgtgggaatcgagccactggagggcaggcacgagaagggcaacttccagaagacaatcgtgaagtataccaatacagtgggctacgccaaccaggacggcaatctgctggtggaggagtctatgctgatccgccctgcctaccggtgctatctgctgctgagcgaggagcacccagatcaccgcaagctgtatgagtacatccgggagggctgggccgagtacatcccttatctgggcaagaacgagtatccagcctggtttggcgactccttccgcgagtacgcctttaagaccttcgtgcctgagacagatttccgggtgtctagcctgtttatcaaggagggcgtgctgaagggccagcaggtgaaggcctccttctcttttagcctgaagggcatcgtgaatagaggcagcttcgtgtacttcgagaggctgcccgtgggcttccaccctgtgctgatgcagtacgagctggccgacttcgcctttaccgattggacactgcaggccgccacccagatggtgaacctgtaccagctggaggaggagggcaagatcgtgcagctgtttggctccggcgaaggcagaggctctctgctgacatgtggcgacgtggaagaaaaccctggacctcccaagaaaaagaggaaagtgggcggcagccagctggtgaagtccgagctggaggagaagaagtccgagctgcgccacaagctgaagtatgtgccccacgagtacatcgagctgatcgagatcgccagaaaccctacccaggacagaatcctggagatgaaagtgatggagttctttatgaaggtgtatggatacaggggagagcacctgggaggctctcggaagccagatggagccatctataccgtgggcagccctatcgactacggcgtgatcgtggatacaaaggcctacagcggcggctataacctgccaatcggccaggccgatgagatgcagagatatgtggaggagaaccagaccaggaataagcacatcaaccccaatgagtggtggaaggtgtacccttcctctgtgacagagttcaagtttctgttcgtgagcggccacttcaagggcaactataaggcccagctgacccggctgaatcacatcacaaactgcaatggagccgtgctgtccgtggaggagctgctgatcggcggcgagatgatcaaggcaggcaccctgacactggaggaggtgcggagaaagttcaacaatggcgagatcaacttttctgctagcgagacacctggcacctccgagtctgccaccccagagtccggcggctctggctctagcggcggctctggctcctccggaggaatgctgcaggagatcaacaatttcatgaattctctgccagcagagctgaagcaggcaggcctgaagccaaaggagggactgcacgtgctgctgaagatccaggagaaggagggcacccactttatggacgagcagtccgtgtgccgggtgtgcctgacccggaaggcaacagagtttgattaccccttcctgcagcactgcgcagagctggcccaagtgggatggtgcgtgaacacaaataagtgtttcgacctgcctgccaagggcctgcactcttgcagcccatattgtatcgccctgaagagagagagcctggagggaggcggcaagtacgcaaaggacaagaccaagatctatgacaggatcgatacatactttgccaacgccctgagctacgtggaggaggattccgagaaggagcggatcagagtgtttcagcacttcatcaactccaaggagaagctgaatgccctgtttgcctgtttccagtctgaggtggacgaggtgaaggataaggagtacatcatcctgtatctggaggaggagatggagaagtataggcgcgtgcacgagaagtacctgtccgacaagctgttcaacaccaatgagtataacatcagcgtggagaatcagctgtacggcacctccgattttctgaacggcttcccaacaaagaagcccttcctgagccaccagtccgccgtgtttgacatcgcaggaaggatcaccggagagatggcaggcaacctgcacgattttcaggagatcatgcggagaaatgtgctgcctcgcccactgcccctgttcgtgtatcgggaggagctgcagacagagatgctggccgtgtttagcagatacctggccgacggcaagaggatcggctatcaggagatcatccgcgagctgtacaagaaccaccaggacgatatcggcgactactatctgctgtactattacggcgataccgtgtgcgactttgatttcgtgtctaggttccgctacaggctgcagagcggcgacaaggagggatggatggtgaaggatcactttcagatcggcttcaccgagaagatcagccacgtgttcgagctggaggagaaggtgctgcgggagatctttaacaattccctgatcaccagaacaaaggccggcgacacacagaggaagtatttcgatgagctggagcccaagtactgtaagtctgagaacaattatctgctggtgctgaagtacagacaggccttctatgactacatctataagagccgcctgcaggcagtgacccggcctatgtttgatcacatcctgctgacaggcatcctggaggacatcagactggatgagctgaagggcaaccagcacacccagaggtggggcatcctgtccaagatgaatatctggttctctctggccgagcggttcgacctgcagttcaagaacaccgatacaatggccagcaagctggaggagcagcgggtgttcatggtggccctgtcccagggagaggcaatcctggagaatgacgagcagtacgcctttgccgccggccaggtcatctactacctgctgcacaagtctaagaccgccgataagagctataagaggctggagcccttcctgcagcaggtgcacgcctccgagctgaacaaggccatcgcccgcctgtttgacacctacaagcacgagaacttttctggcaatttccggcacccatttgccagcgtgatggcctatcagacacaggccaatatgcgcgactacctgcccatgatgctggccggcatcttcagcgataacctgctgttttccgtgaataagtctgaggagaccaacgaggagaattga

SEQ ID NO: 1259 - DNA, 4341 bp, Bacillus halodurans C-125
atgggccccaagaagaagagaaaggtaggcagcggcatgaccatcctggatcacaagatcgacttcgccgtgatcctgtccgtgacaaaggccaatcctaacggcgacccactgaatggcaacaggcctcgccagaattacgatggccacggcgagatctctgacgtggccatcaagagaaagatcagaaacagactgctggatatggaggagcccatctttgtgcagagcgacgataggaaggccgactctttcaagagcctgagggatcgcgccgactccaatcctgagctggccaagatgctgaaggccaagaacgcctctgtggatgagtttgccaagatcgcctgccaggagtggatggacgtgcgctccttcggccaggtgttcgcctttaagggctccaatctgtctgtgggcgtgcggggacccgtgagcatccacaccgccacaagcatcgatccaatcgacatcgtgtctacccagatcacaaagagcgtgaactccgtgaccggcgataagagaagctccgacacaatgggcatgaagcacagggtggattttggcgtgtacgtgttcaagggctccatcaatacccagctggccgagaagaccggctttacaaacgaggacgccgagaagatcaagagagccctgatcacactgttcgagaacgattctagctccgccaggcctgacggctccatggaggtgcacaaggtgtattggtgggagcactctagcaagctgggccagtactcctctgccaaggtgcaccggagcctgaagatcgagtccaagaccgatacaccaaagagcttcgacgattacgccgtggagctgtatgagctggatggcctgggcgtggaagtgatcgacggacagggctccggcgagggaagaggctctctgctgacctgtggcgacgtggaggagaaccctggacctccaaagaagaaaagaaaagtcggcagcggcatgcggaacgaggtgcagtttgagctgttcggcgattacgccctgtttaccgaccccctgacaaagatcggcggcgagaagctgtcctactctgtgcctacctatcaggccctgaagggcatcgccgagtccatctattggaagccaacaatcgtgttcgtgatcgatgagctgagagtgatgaagcccatccagatggagtctaagggcgtgaggcctatcgagtatggcggcggcaacaccctggcccactacacatatctgaaggacgtgcactaccaggtgaaggcccacttcgagtttaatctgcacagacccgatctggcctttgacaggaacgagggcaagcactactctatcctgcagcgcagcctgaaggcaggaggccggagagacatcttcctgggagcaagggagtgccagggatatgtggccccttgtgagtttggctctggcgatggcttctacgacggccagggcaagtatcacctgggcaccatggtgcacggcttcaattacccagatgagacaggccagcaccagctggacgtgaggctgtggtccgccgtgatggagaacggctatatccagtttcctagaccagaggattgccccatcgtgaggcctgtgaaggagatggagccaaagatcttcaatcccgataacgtgcagagcgccgagcagctgctgcacgacctgggaggagagggcagcggcgagggaaggggctccctgctgacttgcggcgacgtggaagaaaaccctggacctcccaagaaaaagaggaaagtgggcggctcccagctggtgaagtctgagctggaggagaagaagtccgagctgagacacaagctgaagtacgtgccacacgagtatatcgagctgatcgagatcgccaggaaccccacccaggatcgcatcctggagatgaaagtgatggagttctttatgaaggtgtacggctataggggagagcacctgggaggctcccggaagccagacggcgccatctacaccgtgggctctcccatcgattatggcgtgatcgtggacacaaaggcctacagcggcggctataatctgcccatcggccaggccgacgagatgcagagatatgtggaggagaatcagaccaggaacaagcacatcaatcccaacgagtggtggaaggtgtaccctagctccgtgacagagttcaagtttctgttcgtgagcggccactttaagggcaattataaggcccagctgacccggctgaaccacatcacaaattgcaacggagccgtgctgtccgtggaggagctgctgatcggcggcgagatgatcaaggccggcaccctgacactggaggaggtgaggcgcaagtttaacaatggcgagatcaacttctctgctagcgagacacctggcacctccgagtctgccaccccagagtccggcggctctggctctagcggcggctctggctcctccggaggaatgagctggctgctgcacctgtacgagacatatgaggccaatctggatcaagtgggcaagaccgtgaagaagggcgaggacagagagtacacactgctgccaatctcccacaccacacagaacgcccacatcgaggtgaccctggacgaggatggcgacttcctgagggccaaggccctgaccaaggagtctacactgatcccatgcacagaggaggcagcctcccgctctggcagcaaggtggcaccataccctctgcacgataagctgagctatgtggccggcgactttgtgaagtacggcggcaagatcaagaatcaggacgatgccccattcgacacctatatcaagaatctgggagagtgggcaaacagcccatacgcaaccgagaaggtgaagtgtatctacacatatctgaagaagggccgcctgatcgaggatctggtggacgccggcgtgctgaagctggatgagaaccagcagctgatcgagaagtgggagaagcggtacgaggagctgctgggcgagaagcctgccatctttagctccggcgcaaccgaccaggccagcgccttcgtgcggttcaacgtgttccacccagagtccatcgacgacgtgtggaaggataaggagatgttcgactcctttatctctttctataacgataagctgggcgaggaggacatctgcttcgtgaccggcaatcggctgcccagcacagagagacacgccaacaagatcaggcacgccgccgataaggccaagctgatcagcgccaatgacaactccggctttaccttccggggccggttcaagaccagccgggaggcagtgggaatcagctacgaggtgtcccagaaggcccacaatgccctgaagtggctgatccaccgccagtccaagtctatcgacgatcgggtgttcctggtgtggtctaatgataacagcctggtgccaaatcccgatgaggacgccgtggacatcatgaagcacgccaacagggagctggagcgcgatccagacaccggacagatcttcgcaggagaggtgaagaaggcaatcggaggctaccgcagcgatctgaactatcagcccgaggtgcacatcctggtgctggactctgccaccacaggccgcatggccgtgctgtactatcggagcctgaataaggagctgtacctgaaccgcctggaggcctggcacgattcttgtgcctgggagcaccggtatcggagagacgagaaggagtttatcagcttctacggcgcccccgccaccaaggatatcgcctttgccgcatatggacctagggcctccgagaaagtgatcaaggacctgatggagcggatgctgccttgcatcgtggatggcaggcgcgtgccaaaggacatcgtgcggagcgccttccagagagcctccaatcccgtgtctatggagagatgggagtgggagaagaccctgtccatcacatgtgccctgatcaggaagatgcacatcgagcagaaggaggagtggggcgtgcctctggataagtctagcaccgaccgcagctacctgtttggccggctgctggccgtggcagatgtgctggagaggggcgccctgggcaaggacgagaccagagccacaaacgccatcaggtacatgaatagctattccaagaaccctggccgcacctggaagacaatccaggagtccctgcagccatatcaggccaagctgggcaccaaggccacatacctgtctaagctggtggatgagatcggcgaccagtttgagcctggcgacttcaacaataacccactgaccgagcagtacctgctgggcttctatagccagcggagagagctgtacaagaagaaggaggaggagacaaaccagtga

SEQ ID NO: 1260 - DNA, 4290 bp, Desulfovibrio vulgaris
atgggccccaagaagaagagaaaggtaggcagcggcatgaccgcaatcgcaaaccgctatgagtttgtgctgctgttcgacgtggagaacggcaatccaaacggcgaccccgatgccggcaatatgcctaggatcgacccagagaccggacacggactggtgacagacgtgtgcctgaagagaaagatcaggaaccacgtggccctgacaaaggagggcgccgagaggttcaacatctacatccaggagaaggccatcctgaatgagacccacgagcgcgcctatacagcctgtgacctgaagccagagcccaagaagctgccaaagaaggtggaggacgccaagcgggtgaccgattggatgtgcacaaacttttacgatatcagaaccttcggcgccgtgatgaccacagaagtgaattgtggacaggtgcggggaccagtgcagatggcctttgccagatccgtggagcccgtggtgcctcaggaggtgtctatcacccggatggccgtgaccacaaaggccgaggccgagaagcagcagggcgacaacagaacaatgggcaggaagcacatcgtgccatacggcctgtatgtggcacacggcttcatcagcgcccccctggccgagaagaccggcttttccgacgaggatctgacactgttctgggacgccctggtgaatatgtttgagcacgatcgctccgccgcaaggggactgatgagctcccggaagctgatcgtgtttaagcaccagaatagactgggcaacgcccctgcccacaagctgttcgacctggtgaaggtgtctagggcagagggctctagcggccctgcacgcagcttcgccgattatgcagtgaccgtgggacaggccccagagggagtggaggtgaaggagatgctgggctccggcgagggaaggggctctctgctgacatgcggcgacgtggaggagaaccctggacctccaaagaagaaaagaaaagtcggcagcggcatgacccacggagcagtgaagacatacggcatcagactgagggtgtggggcgactatgcctgttttacccggcctgagatgaaggtggagagagtgagctacgatgtgatgccaccatccgccgcaaggggcatcctggaggcaatccactggaagccagccatcagatggatcgtggacagaatccacgtgctgcgccccatcgtgttcgataatgtgcggagaaacgaggtgtcctctaagatccctaagccaaacccagcaacagcaatgagggataggaagcccctgtattttctggtggacgatggctccaacaggcagcagagggcagccaccctgctgcggaatgtggactacgtgatcgaggcccacttcgagctgacagacaaggccggcgccgaggataatgccggcaagcacctggatatcttcaggcgccgggcaagggcaggacagagctttcagcagccttgcctgggctgtcgcgagtttccagcctccttcgagctgctggagggcgacgtgccactgtcttgctacgcaggcgagaagcgggatctgggctatatgctgctggacatcgatttcgagagagacatgaccccactgttctttaaggccgtgatggaggatggcgtgatcacccctccatctaggacaagccccgaggtgcgcgcaggcagcggcgagggcaggggctccctgctgacatgtggcgacgtggaagaaaaccctggacctcccaagaaaaagaggaaagtgggcggctcccagctggtgaagtctgagctggaggagaagaagtccgagctgcggcacaagctgaagtacgtgcctcacgagtatatcgagctgatcgagatcgcccggaatccaacccaggacagaatcctggagatgaaagtgatggagttctttatgaaggtgtacggctataggggagagcacctgggaggcagccgcaagcccgatggcgccatctacaccgtgggctcccctatcgactatggcgtgatcgtggatacaaaggcctacagcggcggctataacctgccaatcggacaggcagacgagatgcagcggtacgtggaggagaatcagaccagaaacaagcacatcaatcccaacgagtggtggaaggtgtatcctagctccgtgacagagttcaagtttctgttcgtgtctggccactttaagggcaactacaaggcccagctgaccagactgaatcacatcacaaattgcaacggagccgtgctgagcgtggaggagctgctgatcggcggcgagatgatcaaggccggcaccctgacactggaggaggtgagaaggaagtttaacaatggcgagatcaacttctctgctagcgagacacctggcacctccgagtctgccaccccagagtccggcggctctggctctagcggcggctctggctcctccggaggaatgatcctgcaggccctgcacggatactatcagagaatgtccgccgaccctgatgcaggaatgccaccctacggcaccagcatggagaatatctccttcgccctggtgctggacgccaagggcacactgaggggcatcgaggatctgcgcgagcaggagggcaagaagctgagaccaaggaagatgctggtgcccatcgccgagaagaagggcaatggcatcaagccaaactttctgtgggagaataccagctatatcctgggcgtggacgccaagggcaagcaggagaggaccgataagtgccacgccgccttcatcgcccacatcaaggcctactgtgacaccgcagaccaggatctggcagccgtgctgcagttcctggagcacggcgagaaggatctgtctgcctttcccgtgagcgaggaagtgatcggctccaacatcgtgttcagaatcgagggcgagcccggctttgtgcacgagagacctgcagcaaggcaggcctgggccaattgtctgaacaggagggagcagggactgtgcggacagtgtctgatcaccggcgagaggcagaagcctatcgcccagctgcacccaagcatcaagggaggaagggacggcgtgcggggagcacaggccgtggccagcatcgtgtcctttaacaataccgccttcgagtcttacggcaaggagcagagcatcaacgcacccgtgtcccaggaggcagccttttcttacgtgacagccctgaattatctgctgaatccttccaacaggcagaaggtgaccatcgccgatgccacagtggtgttctgggcagagcgcagctccccagcagaggacatctttgccggcatgttcgatcctccatctaccacagccaagcccgagtctagcaacggaaccccccctgaggactctgaggagggcagccagccagatacagcaagggacgatccacacgcagcagcaaggatgcacgacctgctggtggccatcagatctggcaagagggccaccgatatcatgcccgacatggatgagagcgtgagatttcacgtgctgggcctgtctcctaatgcagcaaggctgagcgtgcggttctgggaggtggacacagtgggccacatgctggataaagtgggcagacactatagggagctggagatcatccctcagtttaacaatgagcaggagttcccatccctgtctaccctgctgagacagacagccgtgctgaataagaccgagaacatctctccagtgctggccggaggactgttcagggcaatgctgacaggaggaccttacccacagagcctgctgccagccgtgctgggacgcatccgggcagagcacgcacggcctgaggacaagtccagatacaggctggaggtggtgacctactatagagccgccctgatcaaggcctatctgatccgcaaccggaagctggaggtgcccgtgtccctggaccctgcaaggaccgataggccatatctgctgggccgcctgtttgccgtgctggagaaggcacaggaggacgcagtgcctggagccaacgccacaatcaaggatcggtacctggccagcgcctccgccaatccaggacaggtgttccacatgctgctgaagaatgcctccaaccacaccgccaagctgcggaaggaccctgagagaaagggctctgccatccactacgagatcatgatgcaggagatcatcgacaatatcagcgatttcccagtgaccatgtcctctgatgagcagggcctgtttatgatcggctactatcaccagaggaaggccctgttcacaaagaagaataaggagaactga

SEQ ID NO: 1261 - DNA, 4497 bp, Geobacillus thermocatenulatus strain KCTC 3921
atgggccccaagaagaagagaaaggtaggcagcggcatgatggagagatatatcgatcccaccaagaggcacgagtttgtgctgctgttcgacgtgaaggatggcaaccctaatggcgacccagatgcaggaaacatgccccgggtggaccctgagacaatgcacggcatcgtgaccgatgtggccatcaagagaaagatcagggactatgccgccatggtgctgggcaagcctatctttatccagtctcagacagccctgaacaccatcatcttccaggcctaccaggatgtgggcgtgaagctggccaccatcgagctgaatgaggaggagaaggagaacggcgagctgatgaattggctgagccagctggaggagcagggactggtgctggaggacaatagagtgatctacacaggcgaggatatcaaggagaaggacatcagggagaagctgaccgagggcctggaggaggcaggcctgaagaagcagctggagaagagcctgcgcaacatggcaaagcggctggcccaggccgccaacaatatgaagatcgatgagcagacccgccagaatgcccagaaggccctgtgccagaagtactatgacgtgcggatgttcggcgccgtgatgtccacaggcctgaacgcaggacaggtgaggggaccaatgcagctgaccttttcccgctctatcgatcccgtgttcccatgggacctgaccatcacaagaagcgccatcacaaaggagtccgatcggagaaggaagcagaccgagatgggccgcaagcccctgatcccttacggcctgtatcggctgcacggcttttacaatcccttcctgggcgagaagacaggagtgaccgcagaggacctggcagatttttgggacgccctggtgcacctgttcgcctttgaccacagcgccgcaaggggagagatgaacgtgcgggccctgtatatcttttcccacgagaatgccaagggctctgcccctgcccacaagctgttcgatctggtgaagatcgagcgccggcagcaggaggcaccaagatccttccacgactacgtgctgctgggaccagcagatgagggacagaaggacgtgtttctggagggcttctctggcgtgaccgtgacacggctggtgggctctggcgagggaagaggcagcctgctgacctgcggcgacgtggaggagaaccctggacctccaaagaagaaaagaaaagtcggctccggcatgcagagaagggccaaggtgcaggtgaaagtgtggggcgagtacgcctgttttacacgcccagagttcaaggtggagcggatcagctatccagtgatgaccccatccgccgcaaggggcgtgctggaggccatcttttggaagcccgagttcagatacgaggtgaggcagatcggcatcctgagcctgggaggacagcaggcaatcctgcggaacgagctgacatccaagcagaacaagaatcctatcgtgatcgagtctgccagggcacagcggaccagcctgatcctgaagaacgtggcctactggatcgtggccgatatcatcctgacaaatagggcagtggaccccgcagccaagtatagagaccagttcaatcgccgggtggagaggggacagtgccaccacacaccttacctgggcacccgcgagtttgccgcctatttcagctccatcgacgaggacgatgtggtgaagccagtggacatggatatcggcaccatgctgctggatttcgcctttatcgaggacggcagcagaaaggagatggagtttctgagatacgaggagaccggaacacgcaccgcagtgggattcgcaaagccactgttctttgaggccaaggtggagaacggctggctgcacgtgcccaaggagacctaccagcagctgtatgccctggagggccagaatgccctgagggtggatggctccggcgagggaaggggctctctgctgacatgtggcgacgtggaagaaaaccctggacctcccaagaaaaagaggaaagtgggcggctcccagctggtgaagtctgagctggaggagaagaagagcgagctgaggcacaagctgaagtacgtgcctcacgagtatatcgagctgatcgagatcgccagaaatccaacccaggatagaatcctggagatgaaagtgatggagttctttatgaaggtgtacggatataggggagagcacctgggaggctccagaaagccagacggagccatctacacagtgggctctcctatcgattatggcgtgatcgtggacaccaaggcctactccggcggctataacctgcccatcggccaggccgacgagatgcagaggtacgtggaggagaaccagacccgcaataagcacatcaaccccaatgagtggtggaaggtgtatccttctagcgtgacagagttcaagtttctgttcgtgagcggccacttcaagggcaactacaaggcccagctgacacggctgaatcacatcaccaactgtaatggagccgtgctgtccgtggaggagctgctgatcggcggcgagatgatcaaggccggcacactgaccctggaggaggtgagaaggaagtttaacaatggcgagatcaacttctctgctagcgagacacctggcacctccgagtctgccaccccagagtccggcggctctggctctagcggcggctctggctcctccggaggaatgcactggagagataagatgctgtatgagctgatcgagctggccgccaagctgcagagggagaagaagctgcctccaatcagctacaagcccaagtccatcaactggatcatcgatctgggaggcgaccagccttacctgaagggaccatttcgccggggagagtataggctggtggaggcacctttccgcctgaggcagggcaaggtgaccgaggagaatgtgaagccatacctgctggccgacgatggcagatatgtgctgggcatcccagagtcccccgagaaggcagacgaggcagagctgatgcacaagggctacgtgaggctgatcgaggaggcctatgagaagacaaagctgaaggagctgaagaaggtgctggattttctgtattctcctatgaagaacgccttccgggagcagatcggcgccaaggacatcgtgacattccaggacgatgaggagagcctgatctttgagaagtccgagatccagaccttctgggccgagtacctggcctccgatctgctgtctgacgatgagtgcgactgtagcgtgtgcggcaagagaagcgcctacgtgaggtatctgccaaatcccgtgcagctgtttggccagtcttgtcagctgaccagctttaacaatccctctttcgagagcatgggcaagacacagaccaacaatgtgcccgtgtgcttcggctgtgccacactggtggtggataccctgaactacctgatcagagaggaccagcaccacacacctctgtatatctccgataggaatatcctgcagtctcagatggccatctactgggtggacgatcagatcgagggcagaggctgcatccagctggacgagaagctgtttgcctctcctatcgagcagtggctgttcgacgaggatacaaaccagcgcaccccccctccagagctgaagcagctggaggagctgctggccctgccaaagacaggaagggagcaggccctgcacctggacaagaccttctttcacatggccgtgctgtccgccaataaggcaaggctggtggtgcgggagtggattcacacctccatctctcagctgctgatgcacctggagcggtacgcagcagccgtgcggatcgtgcagcctacaggcgagaagggctatctgctgccactggccgccctgatcagggcagtggatatgagcccaggcctggtgagacagtgtctgaggacaatctatcagggcgccctgccacctaccgagctgctgcccctggccctgcagcggttcagaagcctgaaggtgctgtctgaccctaaggagacctggagataccactctagcgcctctctgctgaagctggtgctgacatatggcaaggaggaggccaacaccatgcagagcctgaacaatcactgcctgcagcccgcctacatctgtggcaggctgctggccgtgctggaggagatccagagaagggccctgggctaccggatcggctctaccatcgtggatcggttctacggagcagccagcacagcacctgccagcaccttcggctccctgctgaggctgagcaccacagcacacctgccaaaggtgtccggcgagctgggccggctgctggaggaagtgatgaagcagctggacgaggcaggaggatttccaacaatcttcaatctgagggagcaggcagagtttgcactgggcttctaccaccagagggcagagttccgctctcggcaccagagcaaccagacaaatggcaccggcgagtcccagtga

SEQ ID NO: 1262 - DNA, 4806 bp, Vibrio cholerae strain L15 L15_contig8
atgggccccaagaagaagagaaaggtaggctccggcatggccaagaacaatgacatcgcctctgtgctggccttcgagaagaagctggtgcctagcgatggctacctgtttggctgccagtgggagaccaaggagcaggccaccccactgacactgcaggagaagagcgtgagaggcacaatctccaacaggctgaaggccgccgtgcagaacgaccctgccaagctgaatgccgaggtggagaaggccaatctgcagcgggtggatgcctgtgcactgggacaggaccacgataccctgaagctgcacttcacactgaaggtgctgggaggcctggcccagccatctgcctgcaacaatgccctgtttaagcagtcttacagcaccgccgtgagccagtacatcacaaagtatggctgtttcgagctggccaagagatatgccaccaacctggccaatgccaggtttctgtggcggaacagagtgggcgccgaggagatcgaggtgcaggtgaaggccctgaacaagggcgccgagcagacctggaccttcaacgccaagcagttctctaccaggcactttgaccacaacgatagccagctgaattccctggccgacaggatcgcacaggccctggccagcgagacagaccacctgatgctgcagatcgattgctacgccaaagtgggcaaggcccaggaggtgtatccctccgaggagctggtgctggataagggcaacagcaagaccaagaagtccaagatcctgtacgccgtgaacgagcacgccgccatgcactctcagaagatcggcaatgccctgcgcagcatcgacacatggtaccctgattatgcctctgaggagcagagcgccggagcaatcgcaatcgagccctacggcgccgtgaccaatctgggcaaggccttcagaacccctaaggacaagcaggacttctacaccttctttgacaagtgggcaaggggagagagcctgcctagggaggaggatgagcactacgtgatggccgtgctggtgcggggaggcgtgttcggagagtccgacaagggctctggcgagggaagaggcagcctgctgacctgtggcgatgtggaggagaaccctggacctcctaaaaagaaacgaaaggtaggctccggcatgaattactatcaggagatcacactgctgcccgacgcagatatcgccctgggcttcctgtggcagaacgtgtttcagcaggtgcacatcgccctggtggagcacaaggtggcctctaatcagagcctggtggccgtgggcttccctgactacagacaggccaagtttccactgggcgccaagctgaggctgttcgccaaggagcaggtgaccctggagaagctggacatccacagatggctgacaaggctggaggattacgtgcacatcaagggcgtgaagccagtgccctctgacgtgacctatgtgagctttgtgagaaagcaggtgaagtcccccgagcggatcgagagagatatgcagcagaaggccgagctgtgggccgccaagtctggcaagcctctggtggagtgcctggtggacctgcagcagtccaagcccaccgccctgtgctctctgcctttcatctacctgcacagccagcagacaaagcagaggtctccagagaagaacagcaagtttcccctgttcatcgagatgcagcagcagtccacatctcaggacggcggcttcgattgctatggcctgagctccaaggccaatggccagagcatgctggccaccgtgccacactttggctccggcgagggaaggggctctctgctgacatgtggcgacgtggaagaaaaccctggacctccaaagaagaaaagaaaagtcggctccggcatgaatgtgctgatcctgcctcacctgaagatccacaacgccaatgccctgtctagcccctttaccgtgggcttccctgccatgacagcatggctgggattcgtgcacgccctggagagaaagctgtcccaggccggcctgtctgatctgatgctgcacagcaccgcagtggtgtcccacaggtgcgacgtgcagacacacaagggcgagggcgatttcgtgcacagcatcatcggcaccgccaaccccctggacaaggatggcagccgctccgcctttatcgaggaggcccggtgtcacctggacgtgagcctggtcatcgagtggtccggcaatgaggagcaggtgcagcagcctgagtttaccgagcagctgcaggccgtgatcgccacaatgaaggtggcaggaggcgatgtgctggccgtgggcaagccttccgtgaagtctgtgatcaccgaggacgatacaggcagggtgctgaggcagctgatgccaggatacgtgctgatcgagcggagagacctgatgatcgatgccatgcagcagggcgacgatgcaatcgacgccctgctgggctatctgaccgtgcaccaccactgcgagcagctggaggatcagtctgtggtgtggcacagccagcggaagacctccggctggatcgtgcccatcgccacaggcttccagggcatctcccctctgggcgaggccaagaaccagagagaccctagcgtgccacacaggttcgcagagtccgtggtgaccctgggagagtttgtgatggtgcacaagatcaagcacctggacgatatcctgtggcagtaccacccagacctggagaacgatctgtatctgtgccagaaggtgaacgccatcaatgagcaccagggctctggcgaaggcaggggcagcctgctgacatgcggcgatgtggaagagaaccctggacctcccaagaaaaagaggaaagtgggcggctctcagctggtgaagagcgagctggaggagaagaagagcgagctgcggcacaagctgaagtacgtgcctcacgagtatatcgagctgatcgagatcgccagaaacccaacccaggacagaatcctggagatgaaagtgatggagttctttatgaaggtgtacggctatagaggcgagcacctgggcggctctaggaagccagatggcgccatctacaccgtgggcagccccatcgactatggcgtgatcgtggatacaaaggcctactccggcggctataatctgccaatcggacaggcagacgagatgcagcggtacgtggaggagaaccagacccggaataagcacatcaaccccaatgagtggtggaaggtgtacccttcctctgtgacagagttcaagtttctgttcgtgagcggccacttcaagggcaactataaggcccagctgaccagactgaatcacatcacaaactgtaatggagccgtgctgtccgtggaggagctgctgatcggcggcgagatgatcaaggccggcaccctgacactggaggaggtgaggcgcaagttcaacaatggcgagatcaacttttctgctagcgagacacctggcacctccgagtctgccaccccagagtccggcggctctggctctagcggcggctctggctcctccggaggaatgatcgacccagtgatcgccgccttctttgccgagaggaaggaggcctggctgaagaagaatatcagcgccgcaatgtccgatgcagaggtgctggagaagcagcaggagtgcgagcagaacttcctgctggacaattggctgcccgatgcagcaaagagggcaggacagatctctgtggccagccacccatgtacattttcccacccctctgcccgcaagaacaagaatggctacgtgtcctctatcatcgccaagaacaagccacgcatcgacggcttcctgcggtctggcaacgtgagcgtggagccagacgccctgggaaatgcagccgccctggacgtgtacaagtttctgtccctggagatgtctgatcagcgcagcctgctggtgcacatcgagcaggagagcgagctggccaggcagctgctggacatcccttcctgcgagtatcaggccctgagagatggcttcctgaagatggtggactccgatcaggcctctgtgagctcctctaagatcaagcaggtgtactttccaatcgccgacggcgagtatcacctgctgtccctgctgacccactctggccacctgttcgagctgaggaagcgcctggacgccctgaggtttggcgatgccgtgaaggaggcccgggagtgtaagaagaccaaccacttccacccagccggctaccaggagatcttcggcctgaccacaatcggctttggcggcacaaagccccagaacatcagcgtgctgaacaatcagaatgcaggcaaggcacacctgctggcctccatcccccctgagctgacccctcgggacatcagactgccaaagacagatttctttaaggagtccttcaacgcctggcaggccaaggaggtgctggagtctctgcacagactgtttcagaccgactgcaacaatatcaatctgagggacggccgcgattacagaatccagcagtatgtggacctggtcatcgagaagatgtggcaggtgaggctgttcctggaggcctacagcggcgagctgagctccgccctgcctctggagcagaagatctggctgtatccagagtttgcagagcagaggcagcaggaggacgagtggctggataagatcatccgccacatcgcccggggcctgatcaaccactacagccggtccaaagtgatcaccaatcctgtgacactggccgaccaggagctgctggccatcgaggaggtggtggcctccaacaaggagaatctgagatga

SEQ ID NO: 1263 - DNA, 4866 bp, Pseudomonas aeruginosa UCBPP-PA14
atgggccccaagaagaagagaaaggtaggctctggcatgagcaagcccatcctgtccaccgcctctgtgctggcctttgagcggaagctggacccttctgatgccctgatgagcgccggagcatgggcacagagagatgccagccaggagtggccagccgtgacagtgagagagaagtccgtgaggggcaccatctctaaccgcctgaagacaaaggaccgggaccccgcaaagctggatgccagcatccagtcccctaacctgcagaccgtggacgtggccaatctgccaagcgacgccgataccctgaaggtgcgcttcacactgcgggtgctgggaggagcaggaacaccatccgcctgcaatgatgccgcctatagagacaagctgctgcagaccgtggccacatacgtgaacgaccagggatttgcagagctggcccggagatacgcccacaacctggccaatgccaggttcctgtggaggaacagggtgggagcagaggcagtggaggtgcgcatcaatcacatcaggcagggagaggtggcaagggcatggcggtttgatgccctggccatcggcctgagagacttcaaggcagatgcagagctggacgccctggccgagctgatcgccagcggcctgtctggcagcggccacgtgctgctggaggtggtggcctttgccaggatcggcgacggccaggaggtgttcccttcccaggagctgatcctggacaagggcgataagaagggccagaagtccaagaccctgtactctgtgcgggatgcagcagcaatccacagccagaagatcggcaatgccctgagaaccatcgacacatggtatccagacgaggatggactgggaccaatcgcagtggagccttacggctctgtgaccagccagggcaaggcctataggcagcccaagcagaagctggacttctacacactgctggacaattgggtgctgagggatgaggcacctgcagtggagcagcagcactacgtgatcgccaacctgatcaggggaggcgtgttcggagaggcagaggagaagggcagcggcgagggaaggggctccctgctgacctgtggcgacgtggaggagaaccctggacctcctaaaaagaaacgaaaggtaggctccggcatggatcactatctggacatcagactgaggccagatcccgagtttccacccgcccagctgatgtctgtgctgttcggcaagctgcaccaggccctggtggcacagggaggcgaccggatcggcgtgtcttttccagacctggatgagtcccgctctcggctgggagagcggctgagaatccacgccagcgccgacgatctgagagccctgctggccaggccatggctggagggactgcgcgatcacctgcagttcggagagcctgcagtggtgcctcacccaaccccctacagacaggtgtctagggtgcaggccaagagcaacccagagcggctgaggcgccggctgatgagaaggcacgacctgagcgaggaggaggcaaggaagagaatccccgacacagtggcacgcgccctggatctgccctttgtgaccctgcggagccagtccacaggccagcactttcgcctgttcatcaggcacggaccactgcaggtgaccgcagaggagggaggcttcacatgctatggcctgtccaagggcggctttgtgccttggttcggctccggcgaaggcaggggctctctgctgacctgtggcgatgtggaggagaaccctggacctccaaagaagaaaagaaaagtcggctccggcatgtctgtgacagaccctgaggccctgctgctgctgccaagactgagcatccagaacgccaatgccatcagctccccactgacctggggattcccttccccaggcgcctttacaggattcgtgcacgccctgcagcgccgggtgggcatctccctggatatcgagctggacggagtgggaatcgtgtgccaccgctttgaggcccagatctctcagccagccggcaagcggaccaaggtgttcaacctgacacgcaaccccctgaatcgggatggctctaccgcagcaatcgtggaggagggaagagcacacctggaggtgagcctgctgctgggagtgcacggcgacggcctggacgatcacccagcccaggagatcgcaagacaggtgcaggagcaggcaggagcaatgaggctggccggaggctctatcctgccatggtgcaacgagaggtttcccgcccctaatgcagagctgctgatgctgggaggcagcgacgagcagagaaggaagaatcagcgccggctgaccagaaggctgctgccaggattcgcactggtgagcagagaggccctgctgcagcagcacctggagacactgaggaccacactgcctgaggcaaccaccctggacgccctgctggacctgtgcagaatcaactttgagccacctgccacctctagcgaggaggaggccagcccacccgacgcagcctggcaggtgagggataagcctggatggctggtgccaatcccagcaggatacaacgccctgtcccctctgtatctgccaggcgaggtgcgcaatgccagagatagggagacacccctgcggtttgtggagaacctgttcggcctgggcgagtggctgtctcctcacagggtggccgccctgagcgatctgctgtggtatcaccacgccgagcctgacaagggcctgtacagatggagcaccccaaggttcgtggagcacgcaatcgcaggcagcggcgaaggcagaggctccctgctgacatgcggcgacgtggaggagaaccctggacctcccaagaaaaagaggaaagtgggcggcagccagctggtgaagtccgagctggaggagaagaagtccgagctgcggcacaagctgaagtacgtgcctcacgagtatatcgagctgatcgagatcgccagaaacccaacccaggatagaatcctggagatgaaagtgatggagttctttatgaaggtgtacggctatagaggcgagcacctgggaggctccaggaagccagacggagcaatctacaccgtgggctctcctatcgactatggcgtgatcgtggatacaaaggcctacagcggcggctataatctgccaatcggacaggcagacgagatgcagcggtacgtggaggagaaccagacccggaataagcacatcaacccaaatgagtggtggaaggtgtacccctcctctgtgacagagttcaagtttctgttcgtgtctggccacttcaagggcaactataaggcccagctgacccgcctgaatcacatcacaaactgtaatggagccgtgctgtccgtggaggagctgctgatcggcggcgagatgatcaaggcaggcaccctgacactggaggaggtgcgccggaagtttaacaatggcgagatcaacttctctgctagcgagacacctggcacctccgagtctgccaccccagagtccggcggctctggctctagcggcggctctggctcctccggaggaatgacatctcctctgccaacccccacatggcaggagctgagacagtttatcgagagcttcatccaggagaggctgcagggcaagctggataagctgcagcctgacgaggacgataagcggcagaccctgctggccacacacagaagggaggcctggctggccgatgcagcacgccgggtgggacagctgcagctggtgacccacacactgaagccaatccaccctgacgcaaggggctctaatctgcacagcctgccacaggcaccaggacagcctggcctggccggctctcacgagctgggcgataggctggtgagcgacgtggtgggaaacgcagccgccctggacgtgtttaagttcctgtccctgcagtaccagggcaagaacctgctgaattggctgaccgaggatagcgccgaggccctgcaggccctgtccgacaatgcagagcaggcaagagagtggaggcaggcctttatcggaatcaccacagtgaagggagcaccagccagccactccctggccaagcagctgtactttcctctgccaggcagcggctatcacctgctggccccactgttccccacctccctggtgcaccacgtgcacgccctgctgagggaggcaaggttcggcgacgcagccaaggccgccagagaggcacgctcccggcaggagtcttggccacacggctttagcgagtaccctaatctggccatccagaagttcggcggcaccaagccccagaacatctcccagctgaacaatgagagaaggggcgagaactggctgctgccttctctgccccctaattggcagagacagaacgtgaatgccccaatgaggcactccagcgtgttcgagcacgatttcggccgcacccctgaggtgagcagactgaccaggacactgcagcggttcctggccaagacagtgcacaacaatctggccatcagacagaggagggcacagctggtggcacagatctgcgacgaggccctgcagtacgcagcaagactgagggagctggagccaggatggtccgccaccccaggctgtcagctgcacgacgcagagcagctgtggctggaccccctgagggcacagaccgacgagacatttctgcagagaaggctgaggggcgattggccagcagaagtgggaaacaggttcgcaaactggctgaatcgggccgtgagctccgactctcagatcctgggcagccccgaggcagcacagtggagccaggagctgtccaaggagctgaccatgttcaaggagatcctggaggacgagagggattga

SEQ ID NO: 1264 - DNA, 3405 bp, Shewanella putrefaciens CN-32
atgggccccaagaagaagagaaaggtaggcagcggcatgcagaaggtgaccggcatcaagtccgtggacttcaagatcaaggccctgggccacggcgtggtgaactggaatggccccaccacactgacaggcgacgatggcaagaccgtggacaatcacacactgcctaagctgagaggctacaccaacctgacaggcaaggtgaaggatgagaccggctacaagtataagaagcaggccaccgacatcaatttcaaggagacacctctgtacatcagccagaactgcatccggcaccacctgtttagagagcaggccttcgatctgcactatgcctctgacaagaacctgaagaatgtgctggccagcatcaccggactgatcaggggatacgtggtgccaagctcccagtgtaagcggacatcccccctgctgctggaggattttgtggaccagctgggcaacggcaatttcgagcagtacggacaggcaggagcaagggatagcacctccttctttagcaagaccacattcggcgacacagagtacatctcctatggctctatcagcatcgagcagctgcagtttatcagcctggataagaagttcgaccgcgccgccatggtcatcaaggagggagagggagaagtgatcgcagcagagctgcagaattacatccagagcctgaacccctccctgaatcctcaggccatctttcactctaactatgtgcggagaggcaccatcttcgaggagggcgagtgcggcatcctgctgaatgacgatgcagtgaaggccctggtggcagagaccctggagagactggccaacctgtccatcaggcaggccaagggctacatgtatgtggacgatatcacagtggattacaatgactctcacaagatgatgcggatcaagagagatgagagcgagatcatcaacgagcagcacgccccttttgcccagtacttctatgcaaagggctctggcgagggaaggggcagcctgctgacctgtggcgacgtggaggagaaccctggacctcctaaaaagaaacgaaaggtaggctctggcatgaacagctatatcgatatccgcctgaagccagacgcagagatgagggaggcagagctgtctagcaaggtgtttaccaagttccacaaggccctggtgacactgaactcccacaagatcggcatctcttttccacagatgaagctgtccctgggccagctgttcagaatccacggcgatgcctctctgctgcacgatctgcagggcctggactggctgggacctctggccggatactgccaggtgaccgccgtgagcgccgtgccagaccacgtgcagtataggatcgtgtccgtgaagcggagcaatctgagcaaggccaagctgaagaggctgatcgcccgcggcagcatcgacaaggatggcgagaagcggtacaaggtgaagatgctgggccagggctttgataacccatacctggacctgttctcctctagcaccggccaggtgtatagaaagttctttgagttttccgatatccaggcccacccactggatggcgagttcgactcctatggcctgtctaagaccgcaacagtgccatggttcggcagcggcgagggcagaggctccctgctgacatgcggcgacgtggaagagaaccctggacctccaaagaagaaaagaaaagtcggcggctctcagctggtgaagagcgagctggaggagaagaagagcgagctgcgccacaagctgaagtacgtgccccacgagtatatcgagctgatcgagatcgcccggaaccctacccaggatagaatcctggagatgaaagtgatggagttctttatgaaggtgtacggctatagaggcgagcacctgggaggctctaggaagcctgacggagccatctacaccgtgggcagcccaatcgattatggcgtgatcgtggacacaaaggcctactccggcggctataacctgccaatcggacaggcagacgagatgcagcggtacgtggaggagaaccagacccggaataagcacatcaacccaaatgagtggtggaaggtgtacccctcctctgtgacagagttcaagtttctgttcgtgtccggccactttaagggcaattataaggcccagctgacccggctgaaccacatcacaaactgcaatggcgccgtgctgtctgtggaggagctgctgatcggcggcgagatgatcaaggccggcaccctgacactggaggaggtgaggcgcaagtttaacaatggcgagatcaatttctctgctagcgagacacctggcacctccgagtctgccaccccagagtccggcggctctggctctagcggcggctctggctcctccggaggaatgaagatcatcatcgagtacgactcctgctggagaaacgccttcctgggcggctctaacaatgagcctgtgccaaagaagggcagggagtttctgggcagcatgacatccctgaagaaggagggcaacttcaaggtgtgcgagaataccctggatacagtgatgggcgtgctgaacaggctgatcggcgaccagaggaagctgtaccaggcacggtccaagatgtatgagtctgcctactattttgaggccctggaggataaggtgagcttcatcgacaagccccagctgaccaatgagatctcctttatcagaaacatgaatggctctaccgatcagaacgccttcacaggcatgatcaaggtgagcgaccccgtgttcacctctgagtacagccagcagttctggggcgtgctggccctggacttcacccagctgtgcgacttcatcatcaagcagagccaggtggtgggctccatcgagctgaaccccctgtctatcatcaataggctggagagcctgaaccaggagaaggccctggagaatagcgacgatctggcccaggtgctgaaggtgctgaacgagtactttccagacatcgagtatctgaacaataagggcctgatcacccccatcagcatctactgttccgccctgtatctgcagctggcccgcctggagacctccttcaatatgaccacagccaagacaaaggccggcggcatctccggcatctctaagagaggctttaccaagaaggatttcatggacaggtacaccacaggccccaagaagacaatctggggcaacccttttatcaagaaggagaagatcaagggccagggcgaggtgacctctatgatgacaaaggccagcggccagctggagatctccatcgacgtggatcgggacaaggcccaggagatcaagatcctgatcgagaatgccggcgtgtcctctttctacctgggcaagaagggcctggcctatgtgagcaacatcaagctgtga

SEQ ID NO: 1265 - DNA, 3501 bp, Acinetobacter sp. 869535
atgggccccaagaagaagagaaaggtaggcagcggcatggccaaggtgacaggcgtgaagtccgtggacttcaagatcaccgcctacggctatggcgtggtgaactggaatggcccaacaagcctgaccggcaatgacggcaagacagtggataaccacaccctgcccaagctgagaggcttctccaatctgtctggcagggtgaaggaggagacaggctacaagtataggaaggaggcctctgacatcgacttcaacgagacccctctgtacatcagccagaactgcatcaggcaccacctgtttcgcgaccagtccttcgatctgcactatgccaaggacaagaacctgatcgatgtgctggcctctatcaccggactgatcaggggatacgtggtgccaagctcccagtgtaagcggacaagccccctgctgatcaccgacttcatcgatcagctgggcaacggcaattttgagcagctgagcaatgcctctagctccgaggagatcacacaggacgatggctccaagacctacaagcgcggcgagaacagcatcttttccaagaccacattcggcgacaccgagtacatcgcctatggctccatctctatcgagcagctgcagtttatctccctggacaagaagttcgatagagcctctatgatcatcaaggagggcgagggcgagaagatcgccgagagggtgcaggagttcatcaagagcctggaccccagcaaggagcctaaggccatcttccacaagaattacgtgcggaagggcacaatctttaacgagggcgaagtgggcatcctgctggacaatacagccatcgatatcctggtgaaggagaccctgagcatgctggaggagctggtcatcaagcaggccaagggctacatgtgcgccgacaccgtggaggtggactataacgattcccacaagatgatgaggatcaagcgcaatccagaccaggccaaccccgagctgcagcaggattacgccgtgtatttcgaggcacagggcagcggcgagggaagaggctccctgctgacatgtggcgacgtggaggagaaccctggacctcctaaaaagaaacgaaaggtaggcagcggcatgaattactatatcgaggtgaccctgatggagaacgatcagttttctccttacgagctgtggagccagctgtatccacagctgcacctggccctggtggaggcaaagaacgccgacaataaggtgaacatcggcttctcctttccccagtaccgctttcaccaggataagggcgtgggcttcatcggcaccaagctgcggctgtttgccgagtccgaggccgacctgaagaagctggatatccggcggtggctggagagactggaggactatgtgcacgtgacatctatcagggaggtgcccaatgatatcaagaactacgccatctataagaggaagcaggtgaagaccaacgcacagcgcctggccaggcacagagtgaagcggggcgacatcggcttcgatgaggccctggcccgctacagcaatgtggtgaccacaaccaacatgccttatatcgagatgaagagcctgtccacatctgaccagcagtctgagaagcggtttaagctgttcatcgagaagcagtccgccgagaagtctgagacacaggtgttcagcacctacggcctgtctagcgtgtcctctgtgcctgagtttggctccggcgagggaaggggctctctgctgacctgcggcgatgtggaggagaaccctggacctccaaagaagaaaagaaaagtcggcggctctcagctggtgaagagcgagctggaggagaagaagagcgagctgagacacaagctgaagtacgtgcctcacgagtatatcgagctgatcgagatcgcccggaacccaacccaggacagaatcctggagatgaaagtgatggagttctttatgaaggtgtacggctatagaggagagcacctgggaggctccaggaagccagatggagccatctacacagtgggctctcctatcgactatggcgtgatcgtggataccaaggcctactccggcggctataacctgccaatcggacaggcagacgagatgcagcggtacgtggaggagaatcagacacggaacaagcacatcaaccctaatgagtggtggaaggtgtacccaagctccgtgaccgagttcaagtttctgttcgtgagcggccacttcaagggcaattataaggcccagctgacaagactgaaccacatcaccaactgtaatggagccgtgctgtccgtggaggagctgctgatcggcggcgagatgatcaaggccggcacactgaccctggaggaggtgaggcgcaagtttaacaatggcgagatcaatttctctgctagcgagacacctggcacctccgagtctgccaccccagagtccggcggctctggctctagcggcggctctggctcctccggaggaatgcagatcatcatcgagtacgagagctcctggcgcaactccttcctggacggctctaacaatgagcctctgccaaagggcggccggaacttcatcgcctccatgacaaccctgaagcaggagggcaactacaagaagcggagcatctctaaggatacagtgatgggcatcctgaacaggctgatcggcgaccagcgcaagctgtatcaggcccggcaggatgagaattactatttcaccgaggtggagaaggtgctgcaggagaacgacatcgtggatcacgccctgaacagcaatgagatggtgtacatcagaaacgtgagcggcagcacagaccagaactccttcaccggagagatcaaggccaatgatcccagcttttctagctccttctccgccgagctgtggggcgtgctgtggctgaacctgtccgaggtgtctaagtttatcctggacgagtcttacagcgtgacatattctgaggtgctggaccccatcaccgtgtgcaatcggatcgaggtgctgagcgccgagaagcctatggacctgaccgaggatatccaggccgtgctggactacctgctgaaccactttccagatacaaagtatctgaccgccaagaagcagctgcccctgatcagcatctacgcctccgccctgtatctgcagatcacacggctgtctcagagatacgacctgagcacagtgctgaccaagtccggcggactgagcggcatctccaagagaggctttaccaagaaggacttcatggataggtacacaaccggcagcaagaagctgatctggggcaatccttatctgctgaaggagaagaagaagggcgagggcgagatcgtgtctgtgctgacaaaggccagcggcaagctgatcatcaacctgaatatctccaaggagcaggccagagacctggaggagaagatcgagaacgccggcgtgtctagcttctacctgggcaagaagggcctggcctatgtgaccgatatcaggccatga

SEQ ID NO: 1266 - DNA, 4806 bp, Vibrio cholerae HE48 vcoHE48.contig.11; identical to SEQ ID NO: 1262

SEQ ID NO: 1267 - DNA, 29 bp, Artificial Sequence
  Synthetic: CRISPR repeats for Oceanicola sp. HL-35
ctgttccccgcacacgcggggatgaaccg

SEQ ID NO: 1268 - DNA, 29 bp, Artificial Sequence
  Synthetic: CRISPR repeats for Pseudomonas sp. S-6-2
gtgttccccgcacctgcggggatgaaccg

SEQ ID NO: 1269 - DNA, 29 bp, Artificial Sequence
  Synthetic: CRISPR repeats for Salmonella enterica subsp. enterica serovar Muenster strain
gtgttccccgcgccagcggggataaaccg

SEQ ID NO: 1270 - DNA, 29 bp, Artificial Sequence
  Synthetic: CRISPR repeats for Atlantibacter hermannii NBRC 105704
gtgttccccgcgccagcggggataaaccg

SEQ ID NO: 1271 - DNA, 29 bp, Artificial Sequence
  Synthetic: CRISPR repeats for Geothermobacter sp. EPR-M
ctgttccccgcacccgcggggatgaaccg

SEQ ID NO: 1272 - DNA, 29 bp, Artificial Sequence
  Synthetic: CRISPR repeats for Methylocaldum sp. 14B
ctgttccccacgtacgtggggatgaaccg

SEQ ID NO: 1273 - DNA, 29 bp, Artificial Sequence
  Synthetic: CRISPR repeats for Methanocella arvoryzae MRE50
aaagtccccacaggcgtgggggtgaaccg

SEQ ID NO: 1274 - DNA, 29 bp, Artificial Sequence
  Synthetic: CRISPR repeats for Pseudomonas aeruginosa DHS01
gtgttccccacatgcgtggggatgaaccg

SEQ ID NO: 1275 - DNA, 28 bp, Artificial Sequence
  Synthetic: CRISPR repeats for Lachnospiraceae bacterium KH1T2
gtattccccacgcacgtgggggtaaatc

SEQ ID NO: 1276 - DNA, 28 bp, Artificial Sequence
  Synthetic: CRISPR repeats for Klebsiella pneumoniae strain VRCO0172
gtattccccacacgcgtgggggtgtttc

SEQ ID NO: 1277 - DNA, 28 bp, Artificial Sequence
  Synthetic: CRISPR repeats for Streptococcus thermophilus strain ND07
gtttttcccgcacacgcgggggtgatcc

SEQ ID NO: 1278 - DNA, 28 bp, Artificial Sequence
  Synthetic: CRISPR repeats for Streptomyces sp. S4
gtcggccccgcacccgcggggatgctcc

SEQ ID NO: 1279 - DNA, 30 bp, Artificial Sequence
  Synthetic: CRISPR repeats for Campylobacter fetus subsp. testudinum Sp3
gtttgctaatgacaatatttgtgttaaaac

SEQ ID NO: 1280 - DNA, 30 bp, Artificial Sequence
  Synthetic: CRISPR repeats for Odoribacter splanchnicus DSM 20712
cttttaattgaactaaggtagaattgaaac

SEQ ID NO: 1281 - DNA, 32 bp, Artificial Sequence
  Synthetic: CRISPR repeats for Bacillus halodurans C-125
gtcgcactcttcatgggtgcgtggattgaaat

SEQ ID NO: 1282 - DNA, 32 bp, Artificial Sequence
  Synthetic: CRISPR repeats for Desulfovibrio vulgaris RCH1 plasmid pDEVAL01
gtcgccccccacgcgggggcgtggattgaaac

SEQ ID NO: 1283 - DNA, 37 bp, Artificial Sequence
  Synthetic: CRISPR repeats for Geobacillus thermocatenulatus strain KCTC 3921
gttgcacccggctattaagccgggtgaggattgaaac

SEQ ID NO: 1284 - DNA, 28 bp, Artificial Sequence
  Synthetic: CRISPR repeats for Vibrio cholerae strain L15 L15_contig8
gttcactgccgtacaggcagcttagaaa

SEQ ID NO: 1285 - DNA, 28 bp, Artificial Sequence
  Synthetic: CRISPR repeats for Pseudomonas aeruginosa UCBPP-PA14
gttcactgccgtgtaggcagctaagaaa

SEQ ID NO: 1286 - DNA, 28 bp, Artificial Sequence
  Synthetic: CRISPR repeats for Shewanella putrefaciens CN-32
gttcaccgccgcacaggcggcttagaaa

SEQ ID NO: 1287 - DNA, 28 bp, Artificial Sequence
  Synthetic: CRISPR repeats for Acinetobacter sp. 869535
gttcactgccatataggcagcttagaaa

SEQ ID NO: 1288 - DNA, 28 bp, Artificial Sequence
  Synthetic: CRISPR repeats for Vibrio cholerae HE48 vcoHE48.contig.11
gttcactgccgcacaggcagcttagaaa

SEQ ID NO: 1289 - DNA, 93 bp, Artificial Sequence
  Synthetic: homolog screen target set1_F_1
cgggcaggcagagctggaggcctttcaggcccctgttccccgcacacgcggggatgaaccgggcctgaggtgctgcctgggcatgtgtaaagg

SEQ ID NO: 1290 - DNA, 93 bp, Artificial Sequence
  Synthetic: homolog screen target set1_F_2
tctgtggctgtcgacatgctaagtgagggcctctgttccccgcacacgcggggatgaaccgtagtctcaagtttgttcaaagctggactcctc

SEQ ID NO: 1291 - DNA, 93 bp, Artificial Sequence
  Synthetic: homolog screen target set1_F_3
atgagtctaggttacattcagtgcaaaaaaccctgttccccgcacacgcggggatgaaccggtaagtttttaaaatatatatctaccatgtat

SEQ ID NO: 1292 - DNA, 93 bp, Artificial Sequence
  Synthetic: homolog screen target set1_F_4
atgattggaattatcttctagctcttgtcgaactgttccccgcacacgcggggatgaaccggtatcaagactgtgacttttaattgtagttta

SEQ ID NO: 1293 - DNA, 93 bp, Artificial Sequence
  Synthetic: homolog screen target set1_F_5
acaagttttgggtctcagcgcaggcctcagttctgttccccgcacacgcggggatgaaccgaggtctgtccagatgctaagaccaggtacttc

SEQ ID NO: 1294 - DNA, 93 bp, Artificial Sequence
  Synthetic: homolog screen target set1_F_6
gatttcctaaaggaatttaacaacaagaccatctgttccccgcacacgcggggatgaaccggttcctctgtctgatggacttattcaatgttt

SEQ ID NO: 1295 - DNA, 93 bp, Artificial Sequence
  Synthetic: homolog screen target set1_F_7
tcttagaccccagccacagggatatttccctgctgttccccgcacacgcggggatgaaccgttccttcgtcatccttgtaatccatcagggtc

SEQ ID NO: 1296 - DNA, 93 bp, Artificial Sequence
  Synthetic: homolog screen target set1_F_8
atgctgctcttcatctctcttatttaccactgctgttccccgcacacgcggggatgaaccgcaggcaatatctggaacttctccagtggcttc

SEQ ID NO: 1297 - DNA, 93 bp, Artificial Sequence
  Synthetic: homolog screen target set1_R_1
cctttacacatgcccaggcagcacctcaggcccggttcatccccgcgtgtgcggggaacaggggcctgaaaggcctccagctctgcctgcccg

SEQ ID NO: 1298 - DNA, 93 bp, Artificial Sequence
  Synthetic: homolog screen target set1_R_2
gaggagtccagctttgaacaaacttgagactacggttcatccccgcgtgtgcggggaacagaggccctcacttagcatgtcgacagccacaga

SEQ ID NO: 1299 - DNA, 93 bp, Artificial Sequence
  Synthetic: homolog screen target set1_R_3
atacatggtagatatatattttaaaaacttaccggttcatccccgcgtgtgcggggaacagggttttttgcactgaatgtaacctagactcat

SEQ ID NO: 1300 - DNA, 93 bp, Artificial Sequence
  Synthetic: homolog screen target set1_R_4
taaactacaattaaaagtcacagtcttgataccggttcatccccgcgtgtgcggggaacagttcgacaagagctagaagataattccaatcat

SEQ ID NO: 1301 - DNA, 93 bp, Artificial Sequence
  Synthetic: homolog screen target set1_R_5
gaagtacctggtcttagcatctggacagacctcggttcatccccgcgtgtgcggggaacagaactgaggcctgcgctgagacccaaaacttgt

SEQ ID NO: 1302 - DNA, 93 bp, Artificial Sequence
  Synthetic: homolog screen target set1_R_6
aaacattgaataagtccatcagacagaggaaccggttcatccccgcgtgtgcggggaacagatggtcttgttgttaaattcctttaggaaatc

SEQ ID NO: 1303 - DNA, 93 bp, Artificial Sequence
  Synthetic: homolog screen target set1_R_7
gaccctgatggattacaaggatgacgaaggaacggttcatccccgcgtgtgcggggaacagcagggaaatatccctgtggctggggtctaaga

SEQ ID NO: 1304 - DNA, 93 bp, Artificial Sequence
  Synthetic: homolog screen target set1_R_8
gaagccactggagaagttccagatattgcctgcggttcatccccgcgtgtgcggggaacagcagtggtaaataagagagatgaagagcagcat

SEQ ID NO: 1305 - DNA, 94 bp, Artificial Sequence
  Synthetic: homolog screen target set2_F_1
aatcagaccactcacagcataggagcagctctggtattccccacacgcgtgggggtgtttcactctgtgcatactctggggctgggagttacca

SEQ ID NO: 1306 - DNA, 94 bp, Artificial Sequence
  Synthetic: homolog screen target set2_F_2
atttctagccttacttccaccttatttcttcccgtattccccacacgcgtgggggtgtttcaaatagctcttcagttgtttctggttaattgag

SEQ ID NO: 1307 - DNA, 94 bp, Artificial Sequence
  Synthetic: homolog screen target set2_F_3
ttctattatgggatctgtaacactttattggatgtattccccacacgcgtgggggtgtttctcattatttctgcctagagatggatcaggaaat

SEQ ID NO: 1308 - DNA, 94 bp, Artificial Sequence
  Synthetic: homolog screen target set2_F_4
aaaataacaagtttcatggaagaatacccaaccgtattccccacacgcgtgggggtgtttcctttaatgattgggaatctggagttaagggaaa

SEQ ID NO: 1309 - DNA, 94 bp, Artificial Sequence
  Synthetic: homolog screen target set2_F_5
tcaccacatagtatgtccctttaaagcattgacgtattccccacacgcgtgggggtgtttcacaaactttctgaacaatacaattttaatgcat

SEQ ID NO: 1310 - DNA, 94 bp, Artificial Sequence
  Synthetic: homolog screen target set2_F_6
tgacggtggaaacgttctctactacgaagtgatgtattccccacacgcgtgggggtgtttcatcagtaacatggaagtctcaaatatttcagca

SEQ ID NO: 1311 - DNA, 94 bp, Artificial Sequence
  Synthetic: homolog screen target set2_F_7
cccttgcccttcttgtggcccagtggttttcaagtattccccacacgcgtgggggtgtttcacgggagaggggaggggaggagttcagaggaag

SEQ ID NO: 1312 - DNA, 94 bp, Artificial Sequence
  Synthetic: homolog screen target set2_F_8
tcacttgaggtcaggagttcaagaccaccctgggtattccccacacgcgtgggggtgtttcgatactgggccagatcattgtttctcaaattgc

SEQ ID NO: 1313 - DNA, 92 bp, Artificial Sequence
  Synthetic: homolog screen target set2_R_1
aggcctctaggaagacaggtggaggttagggatttctaagctgcctgtgcggcagtgaacaacctaattataaggaggttgttttggccatg

SEQ ID NO: 1314 - DNA, 92 bp, Artificial Sequence
  Synthetic: homolog screen target set2_R_2
cgctctggagccgcagtgcgcactgcgctgcgtttctaagctgcctgtgcggcagtgaacttattcaggactgactccccctgccagtccca

SEQ ID NO: 1315 - DNA, 92 bp, Artificial Sequence
  Synthetic: homolog screen target set2_R_3
tatgctcatagcaagatgccacatgaaacagttttctaagctgcctgtgcggcagtgaacggctgcgggcctagaaacaatagctggtgaaa

SEQ ID NO: 1316 - DNA, 92 bp, Artificial Sequence
  Synthetic: homolog screen target set2_R_4
attcaggagatccacattctctttttagtttatttctaagctgcctgtgcggcagtgaactaatactttttagctattaagtaattaagata

SEQ ID NO: 1317 - DNA, 92 bp, Artificial Sequence
  Synthetic: homolog screen target set2_R_5
cctcagaacaacttcctgaaggtgatagcggttttctaagctgcctgtgcggcagtgaacgatttgtggatgccgggttccaactcttcttg

SEQ ID NO: 1318 - DNA, 92 bp, Artificial Sequence
  Synthetic: homolog screen target set2_R_6
tgtccatcactcccataggctgagtttatttatttctaagctgcctgtgcggcagtgaaccaataaatacttatttagaccttgtgctacag

SEQ ID NO: 1319 - DNA, 92 bp, Artificial Sequence
  Synthetic: homolog screen target set2_R_7
ctgggaccctgatggattacaaggatgacgaatttctaagctgcctgtgcggcagtgaacaatatccctgtggctggggtctaagactttga

SEQ ID NO: 1320 - DNA, 92 bp, Artificial Sequence
  Synthetic: homolog screen target set2_R_8
aatattttggtcacatgaagaaatatgcaatatttctaagctgcctgtgcggcagtgaactggcctgtgaatggtctcaactaaccctttca

SEQ ID NO: 1321 - DNA, 102 bp, Artificial Sequence
  Synthetic: homolog screen target set3_F_1
tctggggaatctgtaaaaggtatatagaaactctctgtttgctaatgacaatatttgtgttaaaacaaacaaaaaaactaatctattggtacaatatagtta

SEQ ID NO: 1322 - DNA, 102 bp, Artificial Sequence
  Synthetic: homolog screen target set3_F_2
gtgttttaaagttacaccgatacattccagtgccttgtttgctaatgacaatatttgtgttaaaacataagaaaatcctgttttctctttaggacaggaact

SEQ ID NO: 1323 - DNA, 102 bp, Artificial Sequence
  Synthetic: homolog screen target set3_F_3
aataatagaataatggatcttcagtttacaagttttgtttgctaatgacaatatttgtgttaaaacctgatacctagggaatcagtcttatcccccatagga

SEQ ID NO: 1324 - DNA, 102 bp, Artificial Sequence
  Synthetic: homolog screen target set3_R_1
taactatattgtaccaatagattagtttttttgtttgttttaacacaaatattgtcattagcaaacagagagtttctatataccttttacagattccccaga

SEQ ID NO: 1325 - DNA, 102 bp, Artificial Sequence
  Synthetic: homolog screen target set3_R_2
agttcctgtcctaaagagaaaacaggattttcttatgttttaacacaaatattgtcattagcaaacaaggcactggaatgtatcggtgtaactttaaaacac

SEQ ID NO: 1326 - DNA, 102 bp, Artificial Sequence
  Synthetic: homolog screen target set3_R_3
tcctatgggggataagactgattccctaggtatcaggttttaacacaaatattgtcattagcaaacaaaacttgtaaactgaagatccattattctattatt

SEQ ID NO: 1327 - DNA, 102 bp, Artificial Sequence
  Synthetic: homolog screen target set4_F_1
gtgttttaaagttacaccgatacattccagtgccttcttttaattgaactaaggtagaattgaaacataagaaaatcctgttttctctttaggacaggaact

SEQ ID NO: 1328 - DNA, 102 bp, Artificial Sequence
  Synthetic: homolog screen target set4_F_2
aataatagaataatggatcttcagtttacaagttttcttttaattgaactaaggtagaattgaaacctgatacctagggaatcagtcttatcccccatagga

SEQ ID NO: 1329 - DNA, 102 bp, Artificial Sequence
  Synthetic: homolog screen target set4_R_1
agttcctgtcctaaagagaaaacaggattttcttatgtttcaattctaccttagttcaattaaaagaaggcactggaatgtatcggtgtaactttaaaacac

SEQ ID NO: 1330 - DNA, 102 bp, Artificial Sequence
  Synthetic: homolog screen target set4_R_2
tcctatgggggataagactgattccctaggtatcaggtttcaattctaccttagttcaattaaaagaaaacttgtaaactgaagatccattattctattatt

SEQ ID NO: 1331 - DNA, 100 bp, Artificial Sequence
  Synthetic: homolog screen target set5_F_1
atgactttgtaggtgtctttattgctaggctgtagtcgcactcttcatgggtgcgtggattgaaattgttatcatcatttatggagtgttgccactaacg

SEQ ID NO: 1332 - DNA, 100 bp, Artificial Sequence
  Synthetic: homolog screen target set5_F_2
caaattattccattaccacagcattaatcacacagtcgcactcttcatgggtgcgtggattgaaattgaggaggatacatgtcagatataagttgagatc

SEQ ID NO: 1333 - DNA, 100 bp, Artificial Sequence
  Synthetic: homolog screen target set5_F_3
tccatcttcagtgcctcaacttgctttaacaactgtcgcactcttcatgggtgcgtggattgaaatcaatcatcttacaaaactggaaactgaggcatct

SEQ ID NO: 1334 - DNA, 100 bp, Artificial Sequence
  Synthetic: homolog screen target set5_F_4
tcaccaaatatatgccttcgtgtgtccaaagtatgtcgcactcttcatgggtgcgtggattgaaattatattcaagtaataacacagcattgcctataca

SEQ ID NO: 1335 - DNA, 100 bp, Artificial Sequence
  Synthetic: homolog screen target set5_F_5
tttatgagatatttattggatgaagaaatagagcgtcgcactcttcatgggtgcgtggattgaaatacggagccagaggcctaagttcaattcttggcac

SEQ ID NO: 1336 - DNA, 100 bp, Artificial Sequence
  Synthetic: homolog screen target set5_F_6
cacccccaacccccacctttcctaaggacaggtcgtcgcactcttcatgggtgcgtggattgaaataacccacctcacttactctacatgcagggtccac

SEQ ID NO: 1337 - DNA, 100 bp, Artificial Sequence
  Synthetic: homolog screen target set5_F_7
ttcagagtctggattgacagttatttttgaaattgtcgcactcttcatgggtgcgtggattgaaatcaagtagctaatgaaaggaataatcttgctttag

SEQ ID NO: 1338 - DNA, 100 bp, Artificial Sequence
  Synthetic: homolog screen target set5_R_1
cgttagtggcaacactccataaatgatgataacaatttcaatccacgcacccatgaagagtgcgactacagcctagcaataaagacacctacaaagtcat

SEQ ID NO: 1339 - DNA, 100 bp, Artificial Sequence
  Synthetic: homolog screen target set5_R_2
gatctcaacttatatctgacatgtatcctcctcaatttcaatccacgcacccatgaagagtgcgactgtgtgattaatgctgtggtaatggaataatttg

SEQ ID NO: 1340 - DNA, 100 bp, Artificial Sequence
  Synthetic: homolog screen target set5_R_3
agatgcctcagtttccagttttgtaagatgattgatttcaatccacgcacccatgaagagtgcgacagttgttaaagcaagttgaggcactgaagatgga

SEQ ID NO: 1341 - DNA, 100 bp, Artificial Sequence
  Synthetic: homolog screen target set5_R_4
tgtataggcaatgctgtgttattacttgaatataatttcaatccacgcacccatgaagagtgcgacatactttggacacacgaaggcatatatttggtga

SEQ ID NO: 1342 - DNA, 100 bp, Artificial Sequence
  Synthetic: homolog screen target set5_R_5
gtgccaagaattgaacttaggcctctggctccgtatttcaatccacgcacccatgaagagtgcgacgctctatttcttcatccaataaatatctcataaa

SEQ ID NO: 1343 - DNA, 100 bp, Artificial Sequence
  Synthetic: homolog screen target set5_R_6
gtggaccctgcatgtagagtaagtgaggtgggttatttcaatccacgcacccatgaagagtgcgacgacctgtccttaggaaaggtgggggttgggggtg

SEQ ID NO: 1344 - DNA, 100 bp, Artificial Sequence
  Synthetic: homolog screen target set5_R_7
ctaaagcaagattattcctttcattagctacttgatttcaatccacgcacccatgaagagtgcgacaatttcaaaaataactgtcaatccagactctgaa

SEQ ID NO: 1345 - DNA, 100 bp, Artificial Sequence
  Synthetic: homolog screen target set6_F_1
atgactttgtaggtgtctttattgctaggctgtagtcgccccccacgcgggggcgtggattgaaactgttatcatcatttatggagtgttgccactaacg

SEQ ID NO: 1346 - DNA, 100 bp, Artificial Sequence
  Synthetic: homolog screen target set6_F_2
caaattattccattaccacagcattaatcacacagtcgccccccacgcgggggcgtggattgaaactgaggaggatacatgtcagatataagttgagatc

SEQ ID NO: 1347 - DNA, 100 bp, Artificial Sequence
  Synthetic: homolog screen target set6_F_3
tttatgagatatttattggatgaagaaatagagcgtcgccccccacgcgggggcgtggattgaaacacggagccagaggcctaagttcaattcttggcac

SEQ ID NO: 1348 - DNA, 100 bp, Artificial Sequence
  Synthetic: homolog screen target set6_F_4
cacccccaacccccacctttcctaaggacaggtcgtcgccccccacgcgggggcgtggattgaaacaacccacctcacttactctacatgcagggtccac

SEQ ID NO: 1349 - DNA, 100 bp, Artificial Sequence
  Synthetic: homolog screen target set6_R_1
cgttagtggcaacactccataaatgatgataacagtttcaatccacgcccccgcgtggggggcgactacagcctagcaataaagacacctacaaagtcat

SEQ ID NO: 1350 - DNA, 100 bp, Artificial Sequence
  Synthetic: homolog screen target set6_R_2
gatctcaacttatatctgacatgtatcctcctcagtttcaatccacgcccccgcgtggggggcgactgtgtgattaatgctgtggtaatggaataatttg

SEQ ID NO: 1351 - DNA, 100 bp, Artificial Sequence
  Synthetic: homolog screen target set6_R_3
gtgccaagaattgaacttaggcctctggctccgtgtttcaatccacgcccccgcgtggggggcgacgctctatttcttcatccaataaatatctcataaa

SEQ ID NO: 1352 - DNA, 100 bp, Artificial Sequence
  Synthetic: homolog screen target set6_R_4
gtggaccctgcatgtagagtaagtgaggtgggttgtttcaatccacgcccccgcgtggggggcgacgacctgtccttaggaaaggtgggggttgggggtg

SEQ ID NO: 1353 - DNA, 107 bp, Artificial Sequence
  Synthetic: homolog screen target set7_F_1
atgactttgtaggtgtctttattgctaggctgtacgttgcacccggctattaagccgggtgaggattgaaactgttatcatcatttatggagtgttgccactaacga

SEQ ID NO: 1354 - DNA, 107 bp, Artificial Sequence
  Synthetic: homolog screen target set7_F_2
tccatcttcagtgcctcaacttgctttaacaactggttgcacccggctattaagccgggtgaggattgaaaccaatcatcttacaaaactggaaactgaggcatcta

SEQ ID NO: 1355 - DNA, 107 bp, Artificial Sequence
  Synthetic: homolog screen target set7_F_3
tcaccaaatatatgccttcgtgtgtccaaagtatagttgcacccggctattaagccgggtgaggattgaaactatattcaagtaataacacagcattgcctatacag

SEQ ID NO: 1356 - DNA, 107 bp, Artificial Sequence
  Synthetic: homolog screen target set7_F_4
cacccccaacccccacctttcctaaggacaggtccgttgcacccggctattaagccgggtgaggattgaaacaacccacctcacttactctacatgcagggtccact

SEQ ID NO: 1357 - DNA, 107 bp, Artificial Sequence
  Synthetic: homolog screen target set7_R_1
tcgttagtggcaacactccataaatgatgataacagtttcaatcctcacccggcttaatagccgggtgcaacgtacagcctagcaataaagacacctacaaagtcat

SEQ ID NO: 1358 - DNA, 107 bp, Artificial Sequence
  Synthetic: homolog screen target set7_R_2
tagatgcctcagtttccagttttgtaagatgattggtttcaatcctcacccggcttaatagccgggtgcaaccagttgttaaagcaagttgaggcactgaagatgga

SEQ ID NO: 1359 - DNA, 107 bp, Artificial Sequence
  Synthetic: homolog screen target set7_R_3
ctgtataggcaatgctgtgttattacttgaatatagtttcaatcctcacccggcttaatagccgggtgcaactatactttggacacacgaaggcatatatttggtga

SEQ ID NO: 1360 - DNA, 107 bp, Artificial Sequence
  Synthetic: homolog screen target set7_R_4
agtggaccctgcatgtagagtaagtgaggtgggttgtttcaatcctcacccggcttaatagccgggtgcaacggacctgtccttaggaaaggtgggggttgggggtg

SEQ ID NO: 1361 - DNA, 92 bp, Artificial Sequence
  Synthetic: homolog screen target set8_F_1
tttcaccagctattgtttctaggcccgcagccgttcactgccgtacaggcagcttagaaaactgtttcatgtggcatcttgctatgagcata

SEQ ID NO: 1362 - DNA, 92 bp, Artificial Sequence
  Synthetic: homolog screen target set8_F_2
tatcttaattacttaatagctaaaaagtattagttcactgccgtacaggcagcttagaaataaactaaaaagagaatgtggatctcctgaat

SEQ ID NO: 1363 - DNA, 92 bp, Artificial Sequence
  Synthetic: homolog screen target set8_F_3
caagaagagttggaacccggcatccacaaatcgttcactgccgtacaggcagcttagaaaaccgctatcaccttcaggaagttgttctgagg

SEQ ID NO: 1364 - DNA, 92 bp, Artificial Sequence
  Synthetic: homolog screen target set8_F_4
ctgtagcacaaggtctaaataagtatttattggttcactgccgtacaggcagcttagaaataaataaactcagcctatgggagtgatggaca

SEQ ID NO: 1365 - DNA, 92 bp, Artificial Sequence
  Synthetic: homolog screen target set8_F_5
tcaaagtcttagaccccagccacagggatattgttcactgccgtacaggcagcttagaaattcgtcatccttgtaatccatcagggtcccag

SEQ ID NO: 1366 - DNA, 92 bp, Artificial Sequence
  Synthetic: homolog screen target set8_R_1
tatgctcatagcaagatgccacatgaaacagttttctaagctgcctgtacggcagtgaacggctgcgggcctagaaacaatagctggtgaaa

SEQ ID NO: 1367 - DNA, 92 bp, Artificial Sequence
  Synthetic: homolog screen target set8_R_2
attcaggagatccacattctctttttagtttatttctaagctgcctgtacggcagtgaactaatactttttagctattaagtaattaagata

SEQ ID NO: 1368 - DNA, 92 bp, Artificial Sequence
  Synthetic: homolog screen target set8_R_3
cctcagaacaacttcctgaaggtgatagcggttttctaagctgcctgtacggcagtgaacgatttgtggatgccgggttccaactcttcttg

SEQ ID NO: 1369 - DNA, 92 bp, Artificial Sequence
  Synthetic: homolog screen target set8_R_4
tgtccatcactcccataggctgagtttatttatttctaagctgcctgtacggcagtgaaccaataaatacttatttagaccttgtgctacag

SEQ ID NO: 1370 - DNA, 92 bp, Artificial Sequence
  Synthetic: homolog screen target set8_R_5
ctgggaccctgatggattacaaggatgacgaatttctaagctgcctgtacggcagtgaacaatatccctgtggctggggtctaagactttga

SEQ ID NO: 1371 - DNA, 92 bp, Artificial Sequence
  Synthetic: homolog screen target set8_F_1
tgggactggcagggggagtcagtcctgaataagttcactgccgtgtaggcagctaagaaacgcagcgcagtgcgcactgcggctccagagcg

SEQ ID NO: 1372 - DNA, 92 bp, Artificial Sequence
  Synthetic: homolog screen target set8_F_2
caagaagagttggaacccggcatccacaaatcgttcactgccgtgtaggcagctaagaaaaccgctatcaccttcaggaagttgttctgagg

SEQ ID NO: 1373 - DNA, 92 bp, Artificial Sequence
  Synthetic: homolog screen target set8_F_3
ctgtagcacaaggtctaaataagtatttattggttcactgccgtgtaggcagctaagaaataaataaactcagcctatgggagtgatggaca

SEQ ID NO: 1374 - DNA, 92 bp, Artificial Sequence
  Synthetic: homolog screen target set8_F_4
tgaaagggttagttgagaccattcacaggccagttcactgccgtgtaggcagctaagaaatattgcatatttcttcatgtgaccaaaatatt

SEQ ID NO: 1375 - DNA, 92 bp, Artificial Sequence
  Synthetic: homolog screen target set8_R_1
cgctctggagccgcagtgcgcactgcgctgcgtttcttagctgcctacacggcagtgaacttattcaggactgactccccctgccagtccca

SEQ ID NO: 1376 - DNA, 92 bp, Artificial Sequence
  Synthetic: homolog screen target set8_R_2
cctcagaacaacttcctgaaggtgatagcggttttcttagctgcctacacggcagtgaacgatttgtggatgccgggttccaactcttcttg

SEQ ID NO: 1377 - DNA, 92 bp, Artificial Sequence
  Synthetic: homolog screen target set8_R_3
tgtccatcactcccataggctgagtttatttatttcttagctgcctacacggcagtgaaccaataaatacttatttagaccttgtgctacag

SEQ ID NO: 1378 - DNA, 92 bp, Artificial Sequence
  Synthetic: homolog screen target set8_R_4
aatattttggtcacatgaagaaatatgcaatatttcttagctgcctacacggcagtgaactggcctgtgaatggtctcaactaaccctttca

SEQ ID NO: 1379 - DNA, 92 bp, Artificial Sequence
  Synthetic: homolog screen target set9_F_1
catggccaaaacaacctccttataattaggttgttcaccgccgcacaggcggcttagaaatccctaacctccacctgtcttcctagaggcct

SEQ ID NO: 1380 - DNA, 92 bp, Artificial Sequence
  Synthetic: homolog screen target set9_F_2
ctgtagcacaaggtctaaataagtatttattggttcaccgccgcacaggcggcttagaaataaataaactcagcctatgggagtgatggaca

SEQ ID NO: 1381 - DNA, 92 bp, Artificial Sequence
  Synthetic: homolog screen target set9_F_3
tcaaagtcttagaccccagccacagggatattgttcaccgccgcacaggcggcttagaaattcgtcatccttgtaatccatcagggtcccag

SEQ ID NO: 1382 - DNA, 92 bp, Artificial Sequence
  Synthetic: homolog screen target set9_R_1
aggcctctaggaagacaggtggaggttagggatttctaagccgcctgtgcggcggtgaacaacctaattataaggaggttgttttggccatg

SEQ ID NO: 1383 - DNA, 92 bp, Artificial Sequence
  Synthetic: homolog screen target set9_R_2
tgtccatcactcccataggctgagtttatttatttctaagccgcctgtgcggcggtgaaccaataaatacttatttagaccttgtgctacag

SEQ ID NO: 1384 - DNA, 92 bp, Artificial Sequence
  Synthetic: homolog screen target set9_R_3
ctgggaccctgatggattacaaggatgacgaatttctaagccgcctgtgcggcggtgaacaatatccctgtggctggggtctaagactttga

SEQ ID NO: 1385 - DNA, 92 bp, Artificial Sequence
  Synthetic: homolog screen target set10_F_1
tgggactggcagggggagtcagtcctgaataagttcactgccatataggcagcttagaaacgcagcgcagtgcgcactgcggctccagagcg

SEQ ID NO: 1386 - DNA, 92 bp, Artificial Sequence
  Synthetic: homolog screen target set10_F_2
tttcaccagctattgtttctaggcccgcagccgttcactgccatataggcagcttagaaaactgtttcatgtggcatcttgctatgagcata

SEQ ID NO: 1387 - DNA, 92 bp, Artificial Sequence
  Synthetic: homolog screen target set10_F_3
tatcttaattacttaatagctaaaaagtattagttcactgccatataggcagcttagaaataaactaaaaagagaatgtggatctcctgaat

SEQ ID NO: 1388 - DNA, 92 bp, Artificial Sequence
  Synthetic: homolog screen target set10_F_4
ctgtagcacaaggtctaaataagtatttattggttcactgccatataggcagcttagaaataaataaactcagcctatgggagtgatggaca

SEQ ID NO: 1389 - DNA, 92 bp, Artificial Sequence
  Synthetic: homolog screen target set10_F_5
tcaaagtcttagaccccagccacagggatattgttcactgccatataggcagcttagaaattcgtcatccttgtaatccatcagggtcccag

SEQ ID NO: 1390 - DNA, 92 bp, Artificial Sequence
  Synthetic: homolog screen target set10_F_6
tgaaagggttagttgagaccattcacaggccagttcactgccatataggcagcttagaaatattgcatatttcttcatgtgaccaaaatatt

SEQ ID NO: 1391 - DNA, 92 bp, Artificial Sequence
  Synthetic: homolog screen target set10_R_1
cgctctggagccgcagtgcgcactgcgctgcgtttctaagctgcctatatggcagtgaacttattcaggactgactccccctgccagtccca

SEQ ID NO: 1392 - DNA, 92 bp, Artificial Sequence
  Synthetic: homolog screen target set10_R_2
tatgctcatagcaagatgccacatgaaacagttttctaagctgcctatatggcagtgaacggctgcgggcctagaaacaatagctggtgaaa

SEQ ID NO: 1393 - DNA, 92 bp, Artificial Sequence
  Synthetic: homolog screen target set10_R_3
attcaggagatccacattctctttttagtttatttctaagctgcctatatggcagtgaactaatactttttagctattaagtaattaagata

SEQ ID NO: 1394 - DNA, 92 bp, Artificial Sequence
  Synthetic: homolog screen target set10_R_4
tgtccatcactcccataggctgagtttatttatttctaagctgcctatatggcagtgaaccaataaatacttatttagaccttgtgctacag

SEQ ID NO: 1395 - DNA, 92 bp, Artificial Sequence
  Synthetic: homolog screen target set10_R_5
ctgggaccctgatggattacaaggatgacgaatttctaagctgcctatatggcagtgaacaatatccctgtggctggggtctaagactttga

SEQ ID NO: 1396 - DNA, 92 bp, Artificial Sequence
  Synthetic: homolog screen target set10_R_6
aatattttggtcacatgaagaaatatgcaatatttctaagctgcctatatggcagtgaactggcctgtgaatggtctcaactaaccctttca

SEQ ID NO: 1397 - DNA, 92 bp, Artificial Sequence
  Synthetic: homolog screen target set11_F_1
tgggactggcagggggagtcagtcctgaataagttcactgccgcacaggcagcttagaaacgcagcgcagtgcgcactgcggctccagagcg

SEQ ID NO: 1398 - DNA, 92 bp, Artificial Sequence
  Synthetic: homolog screen target set11_F_2
tgaaagggttagttgagaccattcacaggccagttcactgccgcacaggcagcttagaaatattgcatatttcttcatgtgaccaaaatatt

SEQ ID NO: 1399 - DNA, 92 bp, Artificial Sequence; identical to SEQ ID NO: 1314
  Synthetic: homolog screen target set11_R_1

SEQ ID NO: 1400 - DNA, 92 bp, Artificial Sequence; identical to SEQ ID NO: 1320
  Synthetic: homolog screen target set11_R_2

SEQ ID NO: 1401 - DNA, 52 bp, Artificial Sequence; identical to SEQ ID NO: 475
  Synthetic: homolog screen target set1_ilmn_F_1

SEQ ID NO: 1402 - DNA, 52 bp, Artificial Sequence; identical to SEQ ID NO: 1133
  Synthetic: homolog screen target set1_ilmn_F_2

SEQ ID NO: 1403 - DNA, 52 bp, Artificial Sequence; identical to SEQ ID NO: 1138
  Synthetic: homolog screen target set1_ilmn_F_3

SEQ ID NO: 1404 - DNA, 52 bp, Artificial Sequence; identical to SEQ ID NO: 1150
  Synthetic: homolog screen target set1_ilmn_F_4

SEQ ID NO: 1405 - DNA, 52 bp, Artificial Sequence; identical to SEQ ID NO: 1141
  Synthetic: homolog screen target set1_ilmn_F_5

SEQ ID NO: 1406 - DNA, 50 bp, Artificial Sequence; identical to SEQ ID NO: 1159
  Synthetic: homolog screen target set1_ilmn_F_6

SEQ ID NO: 1407 - DNA, 52 bp, Artificial Sequence; identical to SEQ ID NO: 1186
  Synthetic: homolog screen target set1_ilmn_F_7

SEQ ID NO: 1408 - DNA, 54 bp, Artificial Sequence; identical to SEQ ID NO: 1164
  Synthetic: homolog screen target set1_ilmn_F_8

SEQ ID NO: 1409 - DNA, 48 bp, Artificial Sequence; identical to SEQ ID NO: 476
  Synthetic: homolog screen target set1_ilmn_R_1

SEQ ID NO: 1410 - DNA, 48 bp, Artificial Sequence; identical to SEQ ID NO: 1190
  Synthetic: homolog screen target set1_ilmn_R_2

SEQ ID NO: 1411 - DNA, 48 bp, Artificial Sequence; identical to SEQ ID NO: 1195
  Synthetic: homolog screen target set1_ilmn_R_3

SEQ ID NO: 1412 - DNA, 54 bp, Artificial Sequence; identical to SEQ ID NO: 1207
  Synthetic: homolog screen target set1_ilmn_R_4

SEQ ID NO: 1413 - DNA, 48 bp, Artificial Sequence; identical to SEQ ID NO: 1198
  Synthetic: homolog screen target set1_ilmn_R_5

SEQ ID NO: 1414 - DNA, 48 bp, Artificial Sequence; identical to SEQ ID NO: 1216
  Synthetic: homolog screen target set1_ilmn_R_6

SEQ ID NO: 1415 - DNA, 48 bp, Artificial Sequence; identical to SEQ ID NO: 1243
  Synthetic: homolog screen target set1_ilmn_R_7

SEQ ID NO: 1416 - DNA, 52 bp, Artificial Sequence; identical to SEQ ID NO: 1221
  Synthetic: homolog screen target set1_ilmn_R_8

SEQ ID NO: 1417 - DNA, 52 bp, Artificial Sequence
  Synthetic: homolog screen target set2_ilmn_F_1
cactctttccctacacgacgctcttccgatctaatgcccttctctcttgcct

SEQ ID NO: 1418 - DNA, 52 bp, Artificial Sequence
  Synthetic: homolog screen target set2_ilmn_F_2
cactctttccctacacgacgctcttccgatctacgtcacaaagcgagtgaga

SEQ ID NO: 1419 - DNA, 55 bp, Artificial Sequence
  Synthetic: homolog screen target set2_ilmn_F_3
cactctttccctacacgacgctcttccgatctgatatagcgtctggtatcaaggg

SEQ ID NO: 1420 - DNA, 53 bp, Artificial Sequence
  Synthetic: homolog screen target set2_ilmn_F_4
cactctttccctacacgacgctcttccgatcttttggattagggaggtatggc

SEQ ID NO: 1421 - DNA, 57 bp, Artificial Sequence
  Synthetic: homolog screen target set2_ilmn_F_5
cactctttccctacacgacgctcttccgatctactgtgctttaaacatttgtctgtg

SEQ ID NO: 1422 - DNA, 52 bp, Artificial Sequence
  Synthetic: homolog screen target set2_ilmn_F_6
cactctttccctacacgacgctcttccgatctttccaagattcccagtcacc

SEQ ID NO: 1423 - DNA, 52 bp, Artificial Sequence
  Synthetic: homolog screen target set2_ilmn_F_7
cactctttccctacacgacgctcttccgatctgctgttcaacccacctcact

SEQ ID NO: 1424 - DNA, 52 bp, Artificial Sequence
  Synthetic: homolog screen target set2_ilmn_F_8
cactctttccctacacgacgctcttccgatctccaccacgcctgactaattt

SEQ ID NO: 1425 - DNA, 48 bp, Artificial Sequence
  Synthetic: homolog screen target set2_ilmn_R_1
ggagttcagacgtgtgctcttccgatctgatggaagacaggcttctcg

SEQ ID NO: 1426 - DNA, 48 bp, Artificial Sequence
  Synthetic: homolog screen target set2_ilmn_R_2
ggagttcagacgtgtgctcttccgatctgggcttgtttcttccttcct

SEQ ID NO: 1427 - DNA, 49 bp, Artificial Sequence
  Synthetic: homolog screen target set2_ilmn_R_3
ggagttcagacgtgtgctcttccgatctccctactttccaatcaaggct

SEQ ID NO: 1428 - DNA, 48 bp, Artificial Sequence
  Synthetic: homolog screen target set2_ilmn_R_4
ggagttcagacgtgtgctcttccgatctgggcaagatgagcagagact

SEQ ID NO: 1429 - DNA, 48 bp, Artificial Sequence
  Synthetic: homolog screen target set2_ilmn_R_5
ggagttcagacgtgtgctcttccgatctaagctgttggcctatctgga

SEQ ID NO: 1430 - DNA, 47 bp, Artificial Sequence
  Synthetic: homolog screen target set2_ilmn_R_6
ggagttcagacgtgtgctcttccgatctcatttgtgacagcagcgtg

SEQ ID NO: 1431 - DNA, 47 bp, Artificial Sequence
  Synthetic: homolog screen target set2_ilmn_R_7
ggagttcagacgtgtgctcttccgatctcccagccacagggatattt

SEQ ID NO: 1432 - DNA, 56 bp, Artificial Sequence
  Synthetic: homolog screen target set2_ilmn_R_8
ggagttcagacgtgtgctcttccgatctaaataagtttcacaactatgaacaggtc

SEQ ID NO: 1433 - DNA, 56 bp, Artificial Sequence
  Synthetic: homolog screen target set3_ilmn_F_1
cactctttccctacacgacgctcttccgatctttggacttacagaagagttggaaa

SEQ ID NO: 1434 - DNA, 52 bp, Artificial Sequence
  Synthetic: homolog screen target set3_ilmn_F_2
cactctttccctacacgacgctcttccgatctgtgtatttgggagggaagca

SEQ ID NO: 1435 - DNA, 52 bp, Artificial Sequence
  Synthetic: homolog screen target set3_ilmn_F_3
cactctttccctacacgacgctcttccgatctaaatcgaaatgggattcacg

SEQ ID NO: 1436 - DNA, 52 bp, Artificial Sequence; identical to SEQ ID NO: 1434
  Synthetic: homolog screen target set3_ilmn_R_1

SEQ ID NO: 1437 - DNA, 52 bp, Artificial Sequence; identical to SEQ ID NO: 1435
  Synthetic: homolog screen target set3_ilmn_R_2

SEQ ID NO: 1438 - DNA, 52 bp, Artificial Sequence
  Synthetic: homolog screen target set3_ilmn_R_3
cactctttccctacacgacgctcttccgatctggcgattcacacaactgaaa

SEQ ID NO: 1439 - DNA, 52 bp, Artificial Sequence
  Synthetic: homolog screen target set4_ilmn_F_1
cactctttccctacacgacgctcttccgatctaaagatttgcctgcgtgaat

SEQ ID NO: 1440 - DNA, 52 bp, Artificial Sequence
  Synthetic: homolog screen target set4_ilmn_F_2
cactctttccctacacgacgctcttccgatcttaggtccaagggtagccaag

SEQ ID NO: 1441 - DNA, 52 bp, Artificial Sequence
  Synthetic: homolog screen target set4_ilmn_R_1
cactctttccctacacgacgctcttccgatctatccgtgacactacatgcca

SEQ ID NO: 1442 - DNA, 52 bp, Artificial Sequence
  Synthetic: homolog screen target set4_ilmn_R_2
cactctttccctacacgacgctcttccgatctcccatgctcttaagccactc

SEQ ID NO: 1443 - DNA, 52 bp, Artificial Sequence
  Synthetic: homolog screen target set5_ilmn_F_1
cactctttccctacacgacgctcttccgatctaccatttggccagagtccta

SEQ ID NO: 1444 - DNA, 55 bp, Artificial Sequence
  Synthetic: homolog screen target set5_ilmn_F_2
cactctttccctacacgacgctcttccgatctgcatcaccttcaagaaaggtaca

SEQ ID NO: 1445 - DNA, 52 bp, Artificial Sequence; identical to SEQ ID NO: 1438
  Synthetic: homolog screen target set5_ilmn_F_3

SEQ ID NO: 1446 - DNA, 52 bp, Artificial Sequence; identical to SEQ ID NO: 1439
  Synthetic: homolog screen target set5_ilmn_F_4

SEQ ID NO: 1447 - DNA, 52 bp, Artificial Sequence; identical to SEQ ID NO: 1442
  Synthetic: homolog screen target set5_ilmn_F_5

SEQ ID NO: 1448 - DNA, 52 bp, Artificial Sequence; identical to SEQ ID NO: 1443
  Synthetic: homolog screen target set5_ilmn_F_6

SEQ ID NO: 1449 - DNA, 52 bp, Artificial Sequence
  Synthetic: homolog screen target set5_ilmn_F_7
cactctttccctacacgacgctcttccgatctaggcttgtccctggtaacct

SEQ ID NO: 1450 - DNA, 52 bp, Artificial Sequence; identical to SEQ ID NO: 1440
  Synthetic: homolog screen target set5_ilmn_R_1

SEQ ID NO: 1451 - DNA, 52 bp, Artificial Sequence; identical to SEQ ID NO: 1441
  Synthetic: homolog screen target set5_ilmn_R_2

SEQ ID NO: 1452 - DNA, 52 bp, Artificial Sequence; identical to SEQ ID NO: 1443
  Synthetic: homolog screen target set5_ilmn_R_3

SEQ ID NO: 1453 - DNA, 52 bp, Artificial Sequence
  Synthetic: homolog screen target set5_ilmn_R_4
cactctttccctacacgacgctcttccgatctttgttcccagtgttggttga

SEQ ID NO: 1454 - DNA, 57 bp, Artificial Sequence
  Synthetic: homolog screen target set5_ilmn_R_5
cactctttccctacacgacgctcttccgatcttggatttcatattacagaggcattt

SEQ ID NO: 1455 - DNA, 52 bp, Artificial Sequence
  Synthetic: homolog screen target set5_ilmn_R_6
cactctttccctacacgacgctcttccgatctgtggactagcacttggctcc

SEQ ID NO: 1456 - DNA, 53 bp, Artificial Sequence
  Synthetic: homolog screen target set5_ilmn_R_7
cactctttccctacacgacgctcttccgatctttggcacatggtaaacactca

SEQ ID NO: 1457 - DNA, 52 bp, Artificial Sequence; identical to SEQ ID NO: 1186
  Synthetic: homolog screen target set6_ilmn_F_1

SEQ ID NO: 1458 - DNA, 52 bp, Artificial Sequence
  Synthetic: homolog screen target set6_ilmn_F_2
cactctttccctacacgacgctcttccgatctggaaatcgaccaaagacgag

SEQ ID NO: 1459 - DNA, 52 bp, Artificial Sequence; identical to SEQ ID NO: 1455
  Synthetic: homolog screen target set6_ilmn_F_3

SEQ ID NO: 1460 - DNA, 53 bp, Artificial Sequence; identical to SEQ ID NO: 1456
  Synthetic: homolog screen target set6_ilmn_F_4

SEQ ID NO: 1461 - DNA, 52 bp, Artificial Sequence
  Synthetic: homolog screen target set6_ilmn_R_1
cactctttccctacacgacgctcttccgatctcagaagccctttgagagtgg

SEQ ID NO: 1462 - DNA, 52 bp, Artificial Sequence
  Synthetic: homolog screen target set6_ilmn_R_2
cactctttccctacacgacgctcttccgatctaggcaaatagaattgggctg

SEQ ID NO: 1463 - DNA, 53 bp, Artificial Sequence; identical to SEQ ID NO: 1456
  Synthetic: homolog screen target set6_ilmn_R_3

SEQ ID NO: 1464 - DNA, 52 bp, Artificial Sequence; identical to SEQ ID NO: 1186
  Synthetic: homolog screen target set6_ilmn_R_4

SEQ ID NO: 1465 - DNA, 52 bp, Artificial Sequence; identical to SEQ ID NO: 1458
  Synthetic: homolog screen target set7_ilmn_F_1

SEQ ID NO: 1466 - DNA, 52 bp, Artificial Sequence; identical to SEQ ID NO: 1453
  Synthetic: homolog screen target set7_ilmn_F_2

SEQ ID NO: 1467 - DNA, 57 bp, Artificial Sequence; identical to SEQ ID NO: 1454
  Synthetic: homolog screen target set7_ilmn_F_3

SEQ ID NO: 1468 - DNA, 53 bp, Artificial Sequence; identical to SEQ ID NO: 1456
  Synthetic: homolog screen target set7_ilmn_F_4

SEQ ID NO: 1469 - DNA, 52 bp, Artificial Sequence; identical to SEQ ID NO: 1186
  Synthetic: homolog screen target set7_ilmn_R_1

SEQ ID NO: 1470 - DNA, 52 bp, Artificial Sequence; identical to SEQ ID NO: 1461
  Synthetic: homolog screen target set7_ilmn_R_2

SEQ ID NO: 1471 - DNA, 52 bp, Artificial Sequence; identical to SEQ ID NO: 1458
  Synthetic: homolog screen target set7_ilmn_R_3

SEQ ID NO: 1472 - DNA, 52 bp, Artificial Sequence; identical to SEQ ID NO: 1461
  Synthetic: homolog screen target set7_ilmn_R_4

SEQ ID NO: 1473 - DNA, 49 bp, Artificial Sequence
  Synthetic: homolog screen target set8_ilmn_F_1
ggagttcagacgtgtgctcttccgatctgcagggagtaaaccaacaaca

SEQ ID NO: 1474 - DNA, 48 bp, Artificial Sequence
  Synthetic: homolog screen target set8_ilmn_F_2
ggagttcagacgtgtgctcttccgatctggatctggtgatgagaggga

SEQ ID NO: 1475 - DNA, 49 bp, Artificial Sequence
  Synthetic: homolog screen target set8_ilmn_F_3
ggagttcagacgtgtgctcttccgatctccattcggctctgacagataa

SEQ ID NO: 1476 - DNA, 48 bp, Artificial Sequence; identical to SEQ ID NO: 1474
  Synthetic: homolog screen target set8_ilmn_F_4

SEQ ID NO: 1477 - DNA, 49 bp, Artificial Sequence; identical to SEQ ID NO: 1475
  Synthetic: homolog screen target set8_ilmn_F_5

SEQ ID NO: 1478 - DNA, 48 bp, Artificial Sequence
  Synthetic: homolog screen target set8_ilmn_R_1
ggagttcagacgtgtgctcttccgatctcaggtagtgtgcagcctcaa

SEQ ID NO: 1479 - DNA, 48 bp, Artificial Sequence
  Synthetic: homolog screen target set8_ilmn_R_2
ggagttcagacgtgtgctcttccgatctggttcagaacttgagcaggg

SEQ ID NO: 1480 - DNA, 54 bp, Artificial Sequence; identical to SEQ ID NO: 1207
  Synthetic: homolog screen target set8_ilmn_R_3

SEQ ID NO: 1481 - DNA, 49 bp, Artificial Sequence
  Synthetic: homolog screen target set8_ilmn_R_4
ggagttcagacgtgtgctcttccgatctgctcttcgtagtggtgcattt

SEQ ID NO: 1482 - DNA, 49 bp, Artificial Sequence
  Synthetic: homolog screen target set8_ilmn_R_5
ggagttcagacgtgtgctcttccgatctaagaaatttgcccaaggtcat

SEQ ID NO: 1483 - DNA, 48 bp, Artificial Sequence
  Synthetic: homolog screen target set8_ilmn_F_1
ggagttcagacgtgtgctcttccgatcttggaacacaatgggttgaga

SEQ ID NO: 1484 - DNA, 50 bp, Artificial Sequence
  Synthetic: homolog screen target set8_ilmn_F_2
ggagttcagacgtgtgctcttccgatcttgggttcgtttacacaagtcaa

SEQ ID NO: 1485 - DNA, 48 bp, Artificial Sequence; identical to SEQ ID NO: 1478
  Synthetic: homolog screen target set8_ilmn_F_3

SEQ ID NO: 1486 - DNA, 48 bp, Artificial Sequence; identical to SEQ ID NO: 1479
  Synthetic: homolog screen target set8_ilmn_F_4

SEQ ID NO: 1487 - DNA, 49 bp, Artificial Sequence; identical to SEQ ID NO: 1482
  Synthetic: homolog screen target set8_ilmn_R_1

SEQ ID NO: 1488 - DNA, 48 bp, Artificial Sequence; identical to SEQ ID NO: 1483
  Synthetic: homolog screen target set8_ilmn_R_2

SEQ ID NO: 1489 - DNA, 48 bp, Artificial Sequence
  Synthetic: homolog screen target set8_ilmn_R_3
ggagttcagacgtgtgctcttccgatctgcatcaaagccaggaatctc

SEQ ID NO: 1490 - DNA, 54 bp, Artificial Sequence; identical to SEQ ID NO: 1207
  Synthetic: homolog screen target set8_ilmn_R_4

SEQ ID NO: 1491 - DNA, 49 bp, Artificial Sequence; identical to SEQ ID NO: 1481
  Synthetic: homolog screen target set9_ilmn_F_1

SEQ ID NO: 1492 - DNA, 48 bp, Artificial Sequence; identical to SEQ ID NO: 1483
  Synthetic: homolog screen target set9_ilmn_F_2

SEQ ID NO: 1493 - DNA, 48 bp, Artificial Sequence
  Synthetic: homolog screen target set9_ilmn_F_3
ggagttcagacgtgtgctcttccgatctacaagcccgtgaagatgagt

SEQ ID NO: 1494 - DNA, 51 bp, Artificial Sequence
  Synthetic: homolog screen target set9_ilmn_R_1
ggagttcagacgtgtgctcttccgatctgccaggtaagaggactttaggaa

SEQ ID NO: 1495 - DNA, 48 bp, Artificial Sequence
  Synthetic: homolog screen target set9_ilmn_R_2
ggagttcagacgtgtgctcttccgatcttctctgatgaagacccaggc

SEQ ID NO: 1496 - DNA, 48 bp, Artificial Sequence
  Synthetic: homolog screen target set9_ilmn_R_3
ggagttcagacgtgtgctcttccgatctttcccgtgtcacatagcgta

SEQ ID NO: 1497 - DNA, 48 bp, Artificial Sequence; identical to SEQ ID NO: 1243
  Synthetic: homolog screen target set10_ilmnF_1

SEQ ID NO: 1498 - DNA, 48 bp, Artificial Sequence
  Synthetic: homolog screen target set10_ilmnF_2
ggagttcagacgtgtgctcttccgatctagcacgtttagaatctggcg

SEQ ID NO: 1499 - DNA, 48 bp, Artificial Sequence; identical to SEQ ID NO: 1495
  Synthetic: homolog screen target set10_ilmnF_3

SEQ ID NO: 1500 - DNA, 48 bp, Artificial Sequence; identical to SEQ ID NO: 1496
  Synthetic: homolog screen target set10_ilmnF_4

SEQ ID NO: 1501 - DNA, 50 bp, Artificial Sequence
  Synthetic: homolog screen target set10_ilmnF_5
ggagttcagacgtgtgctcttccgatctaggctagaaatacgtggcaaag

SEQ ID NO: 1502 - DNA, 48 bp, Artificial Sequence
  Synthetic: homolog screen target set10_ilmnF_6
ggagttcagacgtgtgctcttccgatcttggcttcacagtgagcgtag

SEQ ID NO: 1503 - DNA, 48 bp, Artificial Sequence; identical to SEQ ID NO: 1496
  Synthetic: homolog screen target set10_ilmnR_1

SEQ ID NO: 1504 - DNA, 48 bp, Artificial Sequence; identical to SEQ ID NO: 1243
  Synthetic: homolog screen target set10_ilmnR_2

SEQ ID NO: 1505 - DNA, 48 bp, Artificial Sequence; identical to SEQ ID NO: 1498
  Synthetic: homolog screen target set10_ilmnR_3

SEQ ID NO: 1506 - DNA, 48 bp, Artificial Sequence; identical to SEQ ID NO: 1493
  Synthetic: homolog screen target set10_ilmnR_4

SEQ ID NO: 1507 - DNA, 51 bp, Artificial Sequence; identical to SEQ ID NO: 1494
  Synthetic: homolog screen target set10_ilmnR_5

SEQ ID NO: 1508 - DNA, 48 bp, Artificial Sequence; identical to SEQ ID NO: 1496
  Synthetic: homolog screen target set10_ilmnR_6

SEQ ID NO: 1509 - DNA, 48 bp, Artificial Sequence; identical to SEQ ID NO: 1243
  Synthetic: homolog screen target set11_ilmnF_1

SEQ ID NO: 1510 - DNA, 50 bp, Artificial Sequence; identical to SEQ ID NO: 1501
  Synthetic: homolog screen target set11_ilmnF_2

SEQ ID NO: 1511 - DNA, 48 bp, Artificial Sequence; identical to SEQ ID NO: 1498
  Synthetic: homolog screen target set11_ilmnR_1

SEQ ID NO: 1512 - DNA, 50 bp, Artificial Sequence; identical to SEQ ID NO: 1501
  Synthetic: homolog screen target set11_ilmnR_2

SEQ ID NO: 1513 - DNA, 82 bp, Artificial Sequence
  Synthetic: oCB5714
gagggcctatttcccatgattccttcatatttgcatatacgatacaaggctgttagagagataattggaattaatttgactg

SEQ ID NO: 1514 - DNA, 200 bp, Artificial Sequence
  Synthetic: oCB5715
gctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacac

SEQ ID NO: 1515 - DNA, 20 bp, Artificial Sequence
  Synthetic: oCB5717
gccccagctggttctttccg

SEQ ID NO: 1516 - DNA, 200 bp, Artificial Sequence
  Synthetic: Hsa345_Pseud
cccagctggttctttccgaaaaaaacggttcatccccgcaggtgcggggaacacgtactcgtcggcatccaccacgtcgtccatgtcggttcatccccgcaggtgcggggaacacagaatgcatttgccaagtcctacagactccaacggttcatccccgcaggtgcggggaacacggtgtttcgtcctttccacaagat

SEQ ID NO: 1517 - DNA, 200 bp, Artificial Sequence
  Synthetic: Hsa346_Pseud
cccagctggttctttccgaaaaaaacggttcatccccgcaggtgcggggaacacccgcttcccctctcaggccagcttccctaaggcggttcatccccgcaggtgcggggaacacgggtccagtggatgccacagcccagcttggcccggttcatccccgcaggtgcggggaacacggtgtttcgtcctttccacaagat

SEQ ID NO: 1518 - DNA, 200 bp, Artificial Sequence; identical to SEQ ID NO: 1517
  Synthetic: Hsa347_Pseud

SEQ ID NO: 1519 - DNA, 200 bp, Artificial Sequence
  Synthetic: Hsa348_Pseud
cccagctggttctttccgaaaaaaacggttcatccccgcaggtgcggggaacacaagtgcttggtgagggcttccagcagctcctgcggttcatccccgcaggtgcggggaacaccactgtgcccatgctgaaagaggcctgccgggcggttcatccccgcaggtgcggggaacacggtgtttcgtcctttccacaagat

SEQ ID NO: 1520 - DNA, 200 bp, Artificial Sequence
  Synthetic: Hsa349_Pseud
cccagctggttctttccgaaaaaaacggttcatccccgcaggtgcggggaacacacacatgcttttaagaaacgtcaatgtatatccggttcatccccgcaggtgcggggaacacgcatacagcattcaaaaccagtgctggaatagcggttcatccccgcaggtgcggggaacacggtgtttcgtcctttccacaagat

SEQ ID NO: 1521 - DNA, 200 bp, Artificial Sequence
  Synthetic: Hsa350_Pseud
cccagctggttctttccgaaaaaaacggttcatccccgcaggtgcggggaacactgctgggaattccaaccatccaatcggacaagcggttcatccccgcaggtgcggggaacacaaatgttattcatgcttcttattttaaaagtgcggttcatccccgcaggtgcggggaacacggtgtttcgtcctttccacaagat

SEQ ID NO: 1522 - DNA, 200 bp, Artificial Sequence
  Synthetic: Hsa351_Pseud
cccagctggttctttccgaaaaaaacggttcatccccgcaggtgcggggaacactctaaatataaaagaggactgcaatgccatggcggttcatccccgcaggtgcggggaacacggctcaggggcctccaggttcacctcagtcttcggttcatccccgcaggtgcggggaacacggtgtttcgtcctttccacaagat

SEQ ID NO: 1523 - DNA, 200 bp, Artificial Sequence
  Synthetic: Hsa352_Pseud
cccagctggttctttccgaaaaaaacggttcatccccgcaggtgcggggaacacgcatgtttggtaaaaatgtttttgtgagagttcggttcatccccgcaggtgcggggaacacacttaaaaatttttaaatgcccttaaaagtgacggttcatccccgcaggtgcggggaacacggtgtttcgtcctttccacaagat

SEQ ID NO: 1524 - DNA, 200 bp, Artificial Sequence
  Synthetic: Hsa353_Pseud
cccagctggttctttccgaaaaaaacggttcatccccgcaggtgcggggaacacctggctgcacaaacaccttctcgtttcagagtcggttcatccccgcaggtgcggggaacacgtgttttatttttcatgtagtgtgctccaccacggttcatccccgcaggtgcggggaacacggtgtttcgtcctttccacaagat

SEQ ID NO: 1525 - DNA, 200 bp, Artificial Sequence
  Synthetic: Hsa354_Pseud
cccagctggttctttccgaaaaaaacggttcatccccgcaggtgcggggaacacagtcacctgaattttctggtcatccaactcttcggttcatccccgcaggtgcggggaacacgtgcagatacacaccccgcaggaacatccctccggttcatccccgcaggtgcggggaacacggtgtttcgtcctttccacaagat

SEQ ID NO: 1526 - DNA, 200 bp, Artificial Sequence
  Synthetic: Hsa355_Pseud
cccagctggttctttccgaaaaaaacggttcatccccgcaggtgcggggaacactggcatgaggagggggaagcttttttgaatcgcggttcatccccgcaggtgcggggaacacaatgaattgatttccataaagcaaatcttactcggttcatccccgcaggtgcggggaacacggtgtttcgtcctttccacaagat

SEQ ID NO: 1527 - DNA, 200 bp, Artificial Sequence
  Synthetic: Hsa356_Pseud
cccagctggttctttccgaaaaaaacggttcatccccgcaggtgcggggaacacgcagcctctagagccttcttgctttcattttccggttcatccccgcaggtgcggggaacactagctttgggtttcaggcacttcagtaagagacggttcatccccgcaggtgcggggaacacggtgtttcgtcctttccacaagat

SEQ ID NO: 1528 - DNA, 200 bp, Artificial Sequence
  Synthetic: Hsa357_Pseud
cccagctggttctttccgaaaaaaacggttcatccccgcaggtgcggggaacacttttgtttcctgaaattatcacatctccatcacggttcatccccgcaggtgcggggaacactctcttgcagtcgtcagcctgaacataacatccggttcatccccgcaggtgcggggaacacggtgtttcgtcctttccacaagat

SEQ ID NO: 1529 - DNA, 200 bp, Artificial Sequence; identical to SEQ ID NO: 1525
  Synthetic: Hsa358_Pseud

SEQ ID NO: 1530 - DNA, 200 bp, Artificial Sequence
  Synthetic: Hsa359_Pseud
cccagctggttctttccgaaaaaaacggttcatccccgcaggtgcggggaacaccagacttttataatctccagtggcatctttcccggttcatccccgcaggtgcggggaacactattcatctttgccagtctatcaaatctgctgcggttcatccccgcaggtgcggggaacacggtgtttcgtcctttccacaagat

SEQ ID NO: 1531 - DNA, 200 bp, Artificial Sequence
  Synthetic: Hsa360_Pseud
cccagctggttctttccgaaaaaaacggttcatccccgcaggtgcggggaacacgatgcagaaaaggtagactggggccactgggtcggttcatccccgcaggtgcggggaacaccttcctggcagggatgtcagacccagccttggcggttcatccccgcaggtgcggggaacacggtgtttcgtcctttccacaagat

SEQ ID NO: 1532 - DNA, 200 bp, Artificial Sequence
  Synthetic: Hsa361_Pseud
cccagctggttctttccgaaaaaaacggttcatccccgcaggtgcggggaacaccgcaatacaggaacccccaggggaaagatgagcggttcatccccgcaggtgcggggaacacaaaatacagggaagaaacggtaaaaatcaaagcggttcatccccgcaggtgcggggaacacggtgtttcgtcctttccacaagat

SEQ ID NO: 1533 - DNA, 200 bp, Artificial Sequence
  Synthetic: Hsa362_Pseud
cccagctggttctttccgaaaaaaacggttcatccccgcaggtgcggggaacacacacattcggctccctggagccagactctggtcggttcatccccgcaggtgcggggaacaccgattgttcctgggagcttctccagaccttggcggttcatccccgcaggtgcggggaacacggtgtttcgtcctttccacaagat

SEQ ID NO: 1534 - DNA, 200 bp, Artificial Sequence
  Synthetic: Hsa363_Pseud
cccagctggttctttccgaaaaaaacggttcatccccgcaggtgcggggaacaccctccttcccaggtcctccagcccttctgcgacggttcatccccgcaggtgcggggaacactgctctccggccgggccaacgcgcggggcctgcggttcatccccgcaggtgcggggaacacggtgtttcgtcctttccacaagat

SEQ ID NO: 1535 - DNA, 200 bp, Artificial Sequence
  Synthetic: Hsa364_Pseud
cccagctggttctttccgaaaaaaacggttcatccccgcaggtgcggggaacacccgtgaaatgggttgtgggccaaagctttcttcggttcatccccgcaggtgcggggaacactgtatttttcagtaatggcaatgcagatgcagcggttcatccccgcaggtgcggggaacacggtgtttcgtcctttccacaagat

SEQ ID NO: 1536 - DNA, 200 bp, Artificial Sequence
  Synthetic: Hsa365_Pseud
cccagctggttctttccgaaaaaaacggttcatccccgcaggtgcggggaacactctccctagagatataatttagatattcctatcggttcatccccgcaggtgcggggaacacggtgtaaccactgccaataggctgtttctatgcggttcatccccgcaggtgcggggaacacggtgtttcgtcctttccacaagat

SEQ ID NO: 1537 - DNA, 200 bp, Artificial Sequence
  Synthetic: Hsa366_Pseud
cccagctggttctttccgaaaaaaacggttcatccccgcaggtgcggggaacacggagttgccatgattttttcagtaaagggcatcggttcatccccgcaggtgcggggaacacatttatctcctttcttcaggcttccagctggtcggttcatccccgcaggtgcggggaacacggtgtttcgtcctttccacaagat

SEQ ID NO: 1538 - DNA, 200 bp, Artificial Sequence
  Synthetic: Hsa367_Pseud
cccagctggttctttccgaaaaaaacggttcatccccgcaggtgcggggaacaccttctcaccgtgttttctcttggtaactttcccggttcatccccgcaggtgcggggaacacgactgggctccttggtggatgagtttaaggagcggttcatccccgcaggtgcggggaacacggtgtttcgtcctttccacaagat

SEQ ID NO: 1539 - DNA, 200 bp, Artificial Sequence
  Synthetic: Hsa368_Pseud
cccagctggttctttccgaaaaaaacggttcatccccgcaggtgcggggaacactccctctcctgcagcagcctccgcagcgtgcgcggttcatccccgcaggtgcggggaacacttgctgctggtggtggccctggggatcggcctcggttcatccccgcaggtgcggggaacacggtgtttcgtcctttccacaagat

SEQ ID NO: 1540 - DNA, 200 bp, Artificial Sequence
  Synthetic: Hsa369_Pseud
cccagctggttctttccgaaaaaaacggttcatccccgcaggtgcggggaacacacctcagagtatgttctgctgcttgaactttacggttcatccccgcaggtgcggggaacacatgacaaggtggaactagccaatatgaatagacggttcatccccgcaggtgcggggaacacggtgtttcgtcctttccacaagat

SEQ ID NO: 1541 - DNA, 200 bp, Artificial Sequence
  Synthetic: Hsa370_Pseud
cccagctggttctttccgaaaaaaacggttcatccccgcaggtgcggggaacaccatttacctcagagtatgttctgctgcttgaacggttcatccccgcaggtgcggggaacacaaggtggaactagccaatatgaatagacttttcggttcatccccgcaggtgcggggaacacggtgtttcgtcctttccacaagat

SEQ ID NO: 1542 - DNA, 200 bp, Artificial Sequence
  Synthetic: Hsa371_Pseud
cccagctggttctttccgaaaaaaacggttcatccccgcaggtgcggggaacacatactttatcaaattgtaaaattttataaaaccggttcatccccgcaggtgcggggaacacaaatgaaatgcagtttttcaaaaataaatttccggttcatccccgcaggtgcggggaacacggtgtttcgtcctttccacaagat

SEQ ID NO: 1543 - DNA, 200 bp, Artificial Sequence
  Synthetic: Hsa372_Pseud
cccagctggttctttccgaaaaaaacggttcatccccgcaggtgcggggaacacgtaaatatttttaaaattcactgaatttttgtcggttcatccccgcaggtgcggggaacacatcagtaagatcataagcagtgatcgagatctcggttcatccccgcaggtgcggggaacacggtgtttcgtcctttccacaagat

SEQ ID NO: 1544 - DNA, 200 bp, Artificial Sequence
  Synthetic: Hsa373_Pseud
cccagctggttctttccgaaaaaaacggttcatccccgcaggtgcggggaacacctattcaacctccttacatgtcaggtccactgcggttcatccccgcaggtgcggggaacacgtgctgcagcagcacttcaggaacctggaggccggttcatccccgcaggtgcggggaacacggtgtttcgtcctttccacaagat

SEQ ID NO: 1545 - DNA, 200 bp, Artificial Sequence
  Synthetic: Hsa374_Pseud
cccagctggttctttccgaaaaaaacggttcatccccgcaggtgcggggaacacccttcacacaaaagaacagtatatagtacaaacggttcatccccgcaggtgcggggaacacggtgatggtgtagccctcccactttgctgttccggttcatccccgcaggtgcggggaacacggtgtttcgtcctttccacaagat

SEQ ID NO: 1546 - DNA, 200 bp, Artificial Sequence
  Synthetic: Hsa375_Pseud
cccagctggttctttccgaaaaaaacggttcatccccgcaggtgcggggaacacgtagagcagcatccagaaagtctgttattcctcggttcatccccgcaggtgcggggaacacaacactgataccccaaaataggattttccttccggttcatccccgcaggtgcggggaacacggtgtttcgtcctttccacaagat

SEQ ID NO: 1547 - DNA, 200 bp, Artificial Sequence
  Synthetic: Hsa376_Pseud
cccagctggttctttccgaaaaaaacggttcatccccgcaggtgcggggaacactcccagcatgctctggggaggcggctctggctcggttcatccccgcaggtgcggggaacacaaataaacaaaagaaagaaaagaaaaatagcccggttcatccccgcaggtgcggggaacacggtgtttcgtcctttccacaagat

SEQ ID NO: 1548 - DNA, 200 bp, Artificial Sequence
  Synthetic: Hsa377_Pseud
cccagctggttctttccgaaaaaaacggttcatccccgcaggtgcggggaacaccattcggctccctggagccagactctggtcttcggttcatccccgcaggtgcggggaacacgccatcgattgttcctgggagcttctccagaccggttcatccccgcaggtgcggggaacacggtgtttcgtcctttccacaagat

SEQ ID NO: 1549 - DNA, 200 bp, Artificial Sequence
  Synthetic: Hsa378_Pseud
cccagctggttctttccgaaaaaaacggttcatccccgcaggtgcggggaacacaagtcacgcgcagtagaacatgaacggcgcagcggttcatccccgcaggtgcggggaacacgatcataaagacactgttctcccttcaagttccggttcatccccgcaggtgcggggaacacggtgtttcgtcctttccacaagat

SEQ ID NO: 1550 - DNA, 200 bp, Artificial Sequence
  Synthetic: Hsa379_Pseud
cccagctggttctttccgaaaaaaacggttcatccccgcaggtgcggggaacacagtttggtgcgaacgccattctgggggtgtcccggttcatccccgcaggtgcggggaacacaagtcagcgatgtggcggtacagggggacccccggttcatccccgcaggtgcggggaacacggtgtttcgtcctttccacaagat

SEQ ID NO: 1551 - DNA, 200 bp, Artificial Sequence
  Synthetic: Hsa380_Pseud
cccagctggttctttccgaaaaaaacggttcatccccgcaggtgcggggaacacctaaaggtaccctcagtgtcaatgtacatggccggttcatccccgcaggtgcggggaacacttcatttctactgttgtttttgttctctatagcggttcatccccgcaggtgcggggaacacggtgtttcgtcctttccacaagat

SEQ ID NO: 1552 - DNA, 200 bp, Artificial Sequence
  Synthetic: Hsa381_Pseud
cccagctggttctttccgaaaaaaacggttcatccccgcaggtgcggggaacacacttggaaagggtttatcatacctcatagtcgcggttcatccccgcaggtgcggggaacacctttaaaacatatttttctttgttttaagccgcggttcatccccgcaggtgcggggaacacggtgtttcgtcctttccacaagat

SEQ ID NO: 1553 - DNA, 200 bp, Artificial Sequence
  Synthetic: Hsa382_Pseud
cccagctggttctttccgaaaaaaacggttcatccccgcaggtgcggggaacaccataaataagtttccaggctaaaaaaactatccggttcatccccgcaggtgcggggaacactagttttgagatgctaggattatactgtgattcggttcatccccgcaggtgcggggaacacggtgtttcgtcctttccacaagat

SEQ ID NO: 1554 - DNA, 200 bp, Artificial Sequence
  Synthetic: Hsa383_Pseud
cccagctggttctttccgaaaaaaacggttcatccccgcaggtgcggggaacacaggagtcacctgaattttctggtcatccaactcggttcatccccgcaggtgcggggaacacgtgcagatacacaccccgcaggaacatccctccggttcatccccgcaggtgcggggaacacggtgtttcgtcctttccacaagat

SEQ ID NO: 1555 - DNA, 200 bp, Artificial Sequence
  Synthetic: Hsa384_Pseud
cccagctggttctttccgaaaaaaacggttcatccccgcaggtgcggggaacaccccaaccccaggcagcctctagagccttcttgcggttcatccccgcaggtgcggggaacacggtttcaggcacttcagtaagagactttcccccggttcatccccgcaggtgcggggaacacggtgtttcgtcctttccacaagat

SEQ ID NO: 1556 - DNA, 200 bp, Artificial Sequence
  Synthetic: Hsa385_Pseud
cccagctggttctttccgaaaaaaacggttcatccccgcaggtgcggggaacactttcatcccagggttctctcctctcctcacagcggttcatccccgcaggtgcggggaacacgccaaatccttgcgtagcccgaagcggtggcacggttcatccccgcaggtgcggggaacacggtgtttcgtcctttccacaagat

SEQ ID NO: 1557 - DNA, 200 bp, Artificial Sequence
  Synthetic: Hsa386_Pseud
cccagctggttctttccgaaaaaaacggttcatccccgcaggtgcggggaacacccccagcgcctatctttctcctttggggaccacggttcatccccgcaggtgcggggaacaccccgatccactagggatgcactcaccgctggccggttcatccccgcaggtgcggggaacacggtgtttcgtcctttccacaagat

SEQ ID NO: 1558 - DNA, 200 bp, Artificial Sequence
  Synthetic: Hsa387_Pseud
cccagctggttctttccgaaaaaaacggttcatccccgcaggtgcggggaacacgttttcactccagctaacacagatgtaaaagacggttcatccccgcaggtgcggggaacactggtcagtcttttatatctgaaaaatgtgtaacggttcatccccgcaggtgcggggaacacggtgtttcgtcctttccacaagat

SEQ ID NO: 1559 - DNA, 200 bp, Artificial Sequence
  Synthetic: Hsa388_Pseud
cccagctggttctttccgaaaaaaacggttcatccccgcaggtgcggggaacacgttgtaggattctacattaattctcttgtgcccggttcatccccgcaggtgcggggaacacttaaagcaatttaaaaaaccaattcaggcttgcggttcatccccgcaggtgcggggaacacggtgtttcgtcctttccacaagat

SEQ ID NO: 1560 - DNA, 200 bp, Artificial Sequence
  Synthetic: Hsa389_Pseud
cccagctggttctttccgaaaaaaacggttcatccccgcaggtgcggggaacacctcctttccttagtggtgtctatcgaagatcccggttcatccccgcaggtgcggggaacaccccactacctggattcctgcactggctgtgaacggttcatccccgcaggtgcggggaacacggtgtttcgtcctttccacaagat

SEQ ID NO: 1561 - DNA, 200 bp, Artificial Sequence
  Synthetic: Hsa390_Pseud
cccagctggttctttccgaaaaaaacggttcatccccgcaggtgcggggaacacgtcatcggcatggacgtagcggcctccgagttcggttcatccccgcaggtgcggggaacacggcgagatgtacctgctggggtcatcgggagacggttcatccccgcaggtgcggggaacacggtgtttcgtcctttccacaagat

SEQ ID NO: 1562 - DNA, 200 bp, Artificial Sequence
  Synthetic: Hsa391_Pseud
cccagctggttctttccgaaaaaaacggttcatccccgcaggtgcggggaacactaaccgtgaaatgggttgtgggccaaagctttcggttcatccccgcaggtgcggggaacactgtatttttcagtaatggcaatgcagatgcagcggttcatccccgcaggtgcggggaacacggtgtttcgtcctttccacaagat

SEQ ID NO: 1563 - DNA, 200 bp, Artificial Sequence
  Synthetic: Hsa392_Pseud
cccagctggttctttccgaaaaaaacggttcatccccgcaggtgcggggaacacgggttgtcttcattggtgaacagcatgatcctcggttcatccccgcaggtgcggggaacacctcagtgaagtgctgtgggtctgtgccaacctcggttcatccccgcaggtgcggggaacacggtgtttcgtcctttccacaagat

SEQ ID NO: 1564 - DNA, 200 bp, Artificial Sequence
  Synthetic: Hsa393_Pseud
cccagctggttctttccgaaaaaaacggttcatccccgcaggtgcggggaacacttagaaaaataacagtggagagcacagcttcacggttcatccccgcaggtgcggggaacactcctttcccctgtgtgggataatctctcccagcggttcatccccgcaggtgcggggaacacggtgtttcgtcctttccacaagat

SEQ ID NO: 1565 - DNA, 200 bp, Artificial Sequence
  Synthetic: Hsa394_Pseud
cccagctggttctttccgaaaaaaacggttcatccccgcaggtgcggggaacacagttctagtctctctggggccacacagaaactcggttcatccccgcaggtgcggggaacacagctccaagacctggtcccatggtcctgcctacggttcatccccgcaggtgcggggaacacggtgtttcgtcctttccacaagat

SEQ ID NO: 1566 - DNA, 200 bp, Artificial Sequence
  Synthetic: Hsa395_Pseud
cccagctggttctttccgaaaaaaacggttcatccccgcaggtgcggggaacacggagggtgctttgttccttctgcagagtcgtgcggttcatccccgcaggtgcggggaacacggggccggcccaggcctagggtgtggaggagccggttcatccccgcaggtgcggggaacacggtgtttcgtcctttccacaagat

SEQ ID NO: 1567 - DNA, 200 bp, Artificial Sequence
  Synthetic: Hsa396_Pseud
cccagctggttctttccgaaaaaaacggttcatccccgcaggtgcggggaacacgctctgcaaccaggagcccagtggggagggtgcggttcatccccgcaggtgcggggaacacggaggagccttgccatcgggcttcctgtctctcggttcatccccgcaggtgcggggaacacggtgtttcgtcctttccacaagat

SEQ ID NO: 1568 - DNA, 200 bp, Artificial Sequence
  Synthetic: Hsa397_Pseud
cccagctggttctttccgaaaaaaacggttcatccccgcaggtgcggggaacacattaatatccttgtacttacctgtcacaaatacggttcatccccgcaggtgcggggaacacccagatatgaccatgtatttgtggcttaaactcggttcatccccgcaggtgcggggaacacggtgtttcgtcctttccacaagat

SEQ ID NO: 1569 - DNA, 200 bp, Artificial Sequence
  Synthetic: Hsa398_Pseud
cccagctggttctttccgaaaaaaacggttcatccccgcaggtgcggggaacacaatgcccactgacctggtggtgggtagctgctcggttcatccccgcaggtgcggggaacacagaatctctgcccatgagaactctgaggcctccggttcatccccgcaggtgcggggaacacggtgtttcgtcctttccacaagat

SEQ ID NO: 1570 - DNA, 200 bp, Artificial Sequence
  Synthetic: Hsa399_Pseud
cccagctggttctttccgaaaaaaacggttcatccccgcaggtgcggggaacactccttctccctgtatctgaggatcatatactacggttcatccccgcaggtgcggggaacactgatcctgtaatctttttctttccagtaatcccggttcatccccgcaggtgcggggaacacggtgtttcgtcctttccacaagat

SEQ ID NO: 1571 - DNA, 200 bp, Artificial Sequence
  Synthetic: Hsa400_Pseud
cccagctggttctttccgaaaaaaacggttcatccccgcaggtgcggggaacaccgaacaacacaaatggataacggcccgcttaccggttcatccccgcaggtgcggggaacacagtacagggcccgcgcatgcgtggattgtcgtcggttcatccccgcaggtgcggggaacacggtgtttcgtcctttccacaagat

SEQ ID NO: 1572 - DNA, 200 bp, Artificial Sequence
  Synthetic: Hsa401_Pseud
cccagctggttctttccgaaaaaaacggttcatccccgcaggtgcggggaacacatgtaaaagacttttttttatacgataaataacggttcatccccgcaggtgcggggaacaccaagcaataaaaactgtacaatattggtcagtcggttcatccccgcaggtgcggggaacacggtgtttcgtcctttccacaagat

SEQ ID NO: 1573 - DNA, 200 bp, Artificial Sequence
  Synthetic: Hsa402_Pseud
cccagctggttctttccgaaaaaaacggttcatccccgcaggtgcggggaacacagcttgggcagccacctccttaggtgttagtgcggttcatccccgcaggtgcggggaacacacagcggtaaatacagaacagaaaataaccatcggttcatccccgcaggtgcggggaacacggtgtttcgtcctttccacaagat

SEQ ID NO: 1574 - DNA, 200 bp, Artificial Sequence
  Synthetic: Hsa403_Pseud
cccagctggttctttccgaaaaaaacggttcatccccgcaggtgcggggaacacggcggtgggggaagacttaaccgagttgccgtcggttcatccccgcaggtgcggggaacacgggagatgtagtcccgggccgacgcattacctcggttcatccccgcaggtgcggggaacacggtgtttcgtcctttccacaagat

SEQ ID NO: 1575 - DNA, 200 bp, Artificial Sequence
  Synthetic: Hsa404_Pseud
cccagctggttctttccgaaaaaaacggttcatccccgcaggtgcggggaacactggcatgaggagggggaagcttttttgaatcgcggttcatccccgcaggtgcggggaacactttattaatgaattgatttccataaagcaaatcggttcatccccgcaggtgcggggaacacggtgtttcgtcctttccacaagat

SEQ ID NO: 1576 - DNA, 200 bp, Artificial Sequence
  Synthetic: Hsa405_Pseud
cccagctggttctttccgaaaaaaacggttcatccccgcaggtgcggggaacacgtagagcagcatccagaaagtctgttattcctcggttcatccccgcaggtgcggggaacacgtcaaacactgataccccaaaataggattttccggttcatccccgcaggtgcggggaacacggtgtttcgtcctttccacaagat

SEQ ID NO: 1577 - DNA, 200 bp, Artificial Sequence
  Synthetic: Hsa406_Pseud
cccagctggttctttccgaaaaaaacggttcatccccgcaggtgcggggaacacccgcttcccctctcaggccagcttccctaaggcggttcatccccgcaggtgcggggaacacgactctagggtccagtggatgccacagcccagcggttcatccccgcaggtgcggggaacacggtgtttcgtcctttccacaagat

SEQ ID NO: 1578 - DNA, 200 bp, Artificial Sequence; identical to SEQ ID NO: 1577
  Synthetic: Hsa407_Pseud

SEQ ID NO: 1579 - DNA, 200 bp, Artificial Sequence
  Synthetic: Hsa408_Pseud
cccagctggttctttccgaaaaaaacggttcatccccgcaggtgcggggaacacacaaaacataccctatcaatggcactgcccttcggttcatccccgcaggtgcggggaacacttgtgtcctggctaaatcagaactcgaatggccggttcatccccgcaggtgcggggaacacggtgtttcgtcctttccacaagat

SEQ ID NO: 1580 - DNA, 200 bp, Artificial Sequence
  Synthetic: Hsa409_Pseud
cccagctggttctttccgaaaaaaacggttcatccccgcaggtgcggggaacacggccaccctggatgggagccgtgttcattacccggttcatccccgcaggtgcggggaacactggggctggatatgggtgagaacctggagccgcggttcatccccgcaggtgcggggaacacggtgtttcgtcctttccacaagat

SEQ ID NO: 1581 - DNA, 200 bp, Artificial Sequence
  Synthetic: Hsa410_Pseud
cccagctggttctttccgaaaaaaacggttcatccccgcaggtgcggggaacactggacattcatctgtttccactgagtctgagtcggttcatccccgcaggtgcggggaacacaaaaaaaagttatttatcgtataaaaaaaagtcggttcatccccgcaggtgcggggaacacggtgtttcgtcctttccacaagat

SEQ ID NO: 1582 - DNA, 200 bp, Artificial Sequence
  Synthetic: Hsa411_Pseud
cccagctggttctttccgaaaaaaacggttcatccccgcaggtgcggggaacacttttttttttcctcctaaggaaggttttttttcggttcatccccgcaggtgcggggaacacgcactgagacgctgagggtttcaaagtcacatcggttcatccccgcaggtgcggggaacacggtgtttcgtcctttccacaagat

SEQ ID NO: 1583 - DNA, 200 bp, Artificial Sequence
  Synthetic: Hsa412_Pseud
cccagctggttctttccgaaaaaaacggttcatccccgcaggtgcggggaacacagagcacagaagttttctgctgtctttggaatcggttcatccccgcaggtgcggggaacacgtgttcttagaaattgccatcgacagtgagcccggttcatccccgcaggtgcggggaacacggtgtttcgtcctttccacaagat

SEQ ID NO: 1584 - DNA, 200 bp, Artificial Sequence
  Synthetic: Hsa413_Pseud
cccagctggttctttccgaaaaaaacggttcatccccgcaggtgcggggaacacataataagtattctctgttttcaggtgtgtagcggttcatccccgcaggtgcggggaacactggaactttccttccagagatgtggctactaacggttcatccccgcaggtgcggggaacacggtgtttcgtcctttccacaagat

SEQ ID NO: 1585 - DNA, 200 bp, Artificial Sequence
  Synthetic: Hsa414_Pseud
cccagctggttctttccgaaaaaaacggttcatccccgcaggtgcggggaacacgccgtagctgaaattggctgcaccatgtcggccggttcatccccgcaggtgcggggaacaccacttacagtcaaacaccgtgtagttgaagcccggttcatccccgcaggtgcggggaacacggtgtttcgtcctttccacaagat

SEQ ID NO: 1586 - DNA, 200 bp, Artificial Sequence
  Synthetic: Hsa415_Pseud
cccagctggttctttccgaaaaaaacggttcatccccgcaggtgcggggaacacgagcattgcaatttcaacgacgtcacaacccgcggttcatccccgcaggtgcggggaacactcaagctgttcgttaaagttacacaggtccttcggttcatccccgcaggtgcggggaacacggtgtttcgtcctttccacaagat

SEQ ID NO: 1587 - DNA, 200 bp, Artificial Sequence
  Synthetic: Hsa416_Pseud
cccagctggttctttccgaaaaaaacggttcatccccgcaggtgcggggaacactttccacattccacattctcattaacatttagcggttcatccccgcaggtgcggggaacacgatgaaaaatatgcaaacatcactgtggattacggttcatccccgcaggtgcggggaacacggtgtttcgtcctttccacaagat

SEQ ID NO: 1588 - DNA, 200 bp, Artificial Sequence
  Synthetic: Hsa417_Pseud
cccagctggttctttccgaaaaaaacggttcatccccgcaggtgcggggaacacctattccatttacctcagagtatgttctgctgcggttcatccccgcaggtgcggggaacacaaggtggaactagccaatatgaatagacttttcggttcatccccgcaggtgcggggaacacggtgtttcgtcctttccacaagat

SEQ ID NO: 1589 - DNA, 200 bp, Artificial Sequence
  Synthetic: Hsa418_Pseud
cccagctggttctttccgaaaaaaacggttcatccccgcaggtgcggggaacacctagggatcatgaaataataaactgaaaaaaacggttcatccccgcaggtgcggggaacacccatttaatcccatgggcctctgctccctcaacggttcatccccgcaggtgcggggaacacggtgtttcgtcctttccacaagat

SEQ ID NO: 1590 - DNA, 200 bp, Artificial Sequence
  Synthetic: Hsa419_Pseud
cccagctggttctttccgaaaaaaacggttcatccccgcaggtgcggggaacacccagttgagcaggtactgggagccaatattgtcggttcatccccgcaggtgcggggaacactccaccgtgcagctcatcacgcagctcatgcccggttcatccccgcaggtgcggggaacacggtgtttcgtcctttccacaagat

SEQ ID NO: 1591 - DNA, 200 bp, Artificial Sequence
  Synthetic: Hsa420_Pseud
cccagctggttctttccgaaaaaaacggttcatccccgcaggtgcggggaacacggggacagctctggaaaggggacgctcactcccggttcatccccgcaggtgcggggaacacgctggagggtggcagtgggaccgctccggcggcggttcatccccgcaggtgcggggaacacggtgtttcgtcctttccacaagat

SEQ ID NO: 1592 - DNA, 200 bp, Artificial Sequence; identical to SEQ ID NO: 1591
  Synthetic: Hsa421_Pseud

SEQ ID NO: 1593 - DNA, 200 bp, Artificial Sequence
  Synthetic: Hsa422_Pseud
cccagctggttctttccgaaaaaaacggttcatccccgcaggtgcggggaacacaaatggtattaagctcatcatggaatttctgccggttcatccccgcaggtgcggggaacactattttagctgctgtttgaggtttattttgttcggttcatccccgcaggtgcggggaacacggtgtttcgtcctttccacaagat

SEQ ID NO: 1594 - DNA, 200 bp, Artificial Sequence
  Synthetic: Hsa423_Pseud
cccagctggttctttccgaaaaaaacggttcatccccgcaggtgcggggaacactaacagcacatgcatctttccctccagggccacggttcatccccgcaggtgcggggaacactttaacagccacctgctcccctgtattgtccccggttcatccccgcaggtgcggggaacacggtgtttcgtcctttccacaagat

SEQ ID NO: 1595 - DNA, 200 bp, Artificial Sequence
  Synthetic: Hsa424_Pseud
cccagctggttctttccgaaaaaaacggttcatccccgcaggtgcggggaacactgcatgaactatgaccccaatcagaggcctttcggttcatccccgcaggtgcggggaacacttaaagcagcacatggcaggtcttactctgctcggttcatccccgcaggtgcggggaacacggtgtttcgtcctttccacaagat

SEQ ID NO: 1596 - DNA, 200 bp, Artificial Sequence
  Synthetic: Hsa425_Pseud
cccagctggttctttccgaaaaaaacggttcatccccgcaggtgcggggaacacatgtgtgtctaggcaggacctgtggccaagttcggttcatccccgcaggtgcggggaacacgattcactacacgctctggaatgttcagttcccggttcatccccgcaggtgcggggaacacggtgtttcgtcctttccacaagat

SEQ ID NO: 1597 - DNA, 200 bp, Artificial Sequence
  Synthetic: Hsa426_Pseud
cccagctggttctttccgaaaaaaacggttcatccccgcaggtgcggggaacacaccaggagcccagtggggagggtgctttgttccggttcatccccgcaggtgcggggaacacggcctagggtgtggaggagccttgccatcgggcggttcatccccgcaggtgcggggaacacggtgtttcgtcctttccacaagat

SEQ ID NO: 1598 - DNA, 200 bp, Artificial Sequence
  Synthetic: Hsa427_Pseud
cccagctggttctttccgaaaaaaacggttcatccccgcaggtgcggggaacacttgccatgattttttcagtaaagggcatcttccggttcatccccgcaggtgcggggaacacaaatcaaagaaaatttatctcctttcttcaggcggttcatccccgcaggtgcggggaacacggtgtttcgtcctttccacaagat

SEQ ID NO: 1599 - DNA, 200 bp, Artificial Sequence
  Synthetic: Hsa428_Pseud
cccagctggttctttccgaaaaaaacggttcatccccgcaggtgcggggaacacggtttcctttagaaataaagagatctcagcagcggttcatccccgcaggtgcggggaacacgtcttccttcaccttccacaaagcaactctttcggttcatccccgcaggtgcggggaacacggtgtttcgtcctttccacaagat

SEQ ID NO: 1600 - DNA, 200 bp, Artificial Sequence
  Synthetic: Hsa429_Pseud
cccagctggttctttccgaaaaaaacggttcatccccgcaggtgcggggaacacagatcagcaacaatgagggagcagctgcaccacggttcatccccgcaggtgcggggaacactccatctatttgtctggtttttgcagccactacggttcatccccgcaggtgcggggaacacggtgtttcgtcctttccacaagat

SEQ ID NO: 1601 - DNA, 200 bp, Artificial Sequence
  Synthetic: Hsa430_Pseud
cccagctggttctttccgaaaaaaacggttcatccccgcaggtgcggggaacacccatctgggaactcaagcaggaaggaaggttccggttcatccccgcaggtgcggggaacactggcatcaagaggtgggagggccctccgaccacggttcatccccgcaggtgcggggaacacggtgtttcgtcctttccacaagat

SEQ ID NO: 1602 - DNA, 200 bp, Artificial Sequence; identical to SEQ ID NO: 1601
  Synthetic: Hsa431_Pseud

SEQ ID NO: 1603 - DNA, 200 bp, Artificial Sequence
  Synthetic: Hsa432_Pseud
cccagctggttctttccgaaaaaaacggttcatccccgcaggtgcggggaacacaaaacaaaacataccctatcaatggcactgcccggttcatccccgcaggtgcggggaacacttgtgtcctggctaaatcagaactcgaatggccggttcatccccgcaggtgcggggaacacggtgtttcgtcctttccacaagat

SEQ ID NO: 1604 - DNA, 200 bp, Artificial Sequence
  Synthetic: Hsa433_Pseud
cccagctggttctttccgaaaaaaacggttcatccccgcaggtgcggggaacactacttttagaaaaataacagtggagagcacagcggttcatccccgcaggtgcggggaacactcctttcccctgtgtgggataatctctcccagcggttcatccccgcaggtgcggggaacacggtgtttcgtcctttccacaagat

SEQ ID NO: 1605 - DNA, 200 bp, Artificial Sequence
  Synthetic: Hsa434_Pseud
cccagctggttctttccgaaaaaaacggttcatccccgcaggtgcggggaacactttctcccaggaagctttgatttttaccgtttcggttcatccccgcaggtgcggggaacactatcattacaagagagcaggtgcaaaaggttacggttcatccccgcaggtgcggggaacacggtgtttcgtcctttccacaagat

SEQ ID NO: 1606 - DNA, 200 bp, Artificial Sequence
  Synthetic: Hsa435_Pseud
cccagctggttctttccgaaaaaaacggttcatccccgcaggtgcggggaacacgctctgtcgttcgtggcgctcgtggacggctacggttcatccccgcaggtgcggggaacacacttcctccagcagcctcggcggtgccacctccggttcatccccgcaggtgcggggaacacggtgtttcgtcctttccacaagat

SEQ ID NO: 1607 - DNA, 200 bp, Artificial Sequence
  Synthetic: Hsa436_Pseud
cccagctggttctttccgaaaaaaacggttcatccccgcaggtgcggggaacacggtactccccctccttcccaggtcctccagcccggttcatccccgcaggtgcggggaacactgctctccggccgggccaacgcgcggggcctgcggttcatccccgcaggtgcggggaacacggtgtttcgtcctttccacaagat

SEQ ID NO: 1608 - DNA, 200 bp, Artificial Sequence
  Synthetic: Hsa437_Pseud
cccagctggttctttccgaaaaaaacggttcatccccgcaggtgcggggaacacgagcattgcaatttcaacgacgtcacaacccgcggttcatccccgcaggtgcggggaacacttttcaagctgttcgttaaagttacacaggtccggttcatccccgcaggtgcggggaacacggtgtttcgtcctttccacaagat

SEQ ID NO: 1609 - DNA, 200 bp, Artificial Sequence
  Synthetic: Hsa438_Pseud
cccagctggttctttccgaaaaaaacggttcatccccgcaggtgcggggaacacagtgctcgcttcctggtctccttggcgcgaaccggttcatccccgcaggtgcggggaacacagcatagcagaggatgaggacctcagggttcacggttcatccccgcaggtgcggggaacacggtgtttcgtcctttccacaagat

SEQ ID NO: 1610 - DNA, 200 bp, Artificial Sequence
  Synthetic: Hsa439_Pseud
cccagctggttctttccgaaaaaaacggttcatccccgcaggtgcggggaacactttcaacaatgttctctagtttcaagctccagcggttcatccccgcaggtgcggggaacacgtagttcagttattattgagtctcactttctacggttcatccccgcaggtgcggggaacacggtgtttcgtcctttccacaagat

SEQ ID NO: 1611 - DNA, 200 bp, Artificial Sequence
  Synthetic: Hsa440_Pseud
cccagctggttctttccgaaaaaaacggttcatccccgcaggtgcggggaacacacacacccccaaccccaggcagcctctagagccggttcatccccgcaggtgcggggaacacggtttcaggcacttcagtaagagactttcccccggttcatccccgcaggtgcggggaacacggtgtttcgtcctttccacaagat

SEQ ID NO: 1612 - DNA, 52 bp, Artificial Sequence
  Synthetic: Hsa345_ilmn_F
cactctttccctacacgacgctcttccgatcttagcatctctacgggccatt

SEQ ID NO: 1613 - DNA, 52 bp, Artificial Sequence
  Synthetic: Hsa346_ilmn_F
cactctttccctacacgacgctcttccgatctctcgttggaagaggaacagc

SEQ ID NO: 1614 - DNA, 52 bp, Artificial Sequence; identical to SEQ ID NO: 1613
  Synthetic: Hsa347_ilmn_F

SEQ ID NO: 1615 - DNA, 52 bp, Artificial Sequence
  Synthetic: Hsa348_ilmn_F
cactctttccctacacgacgctcttccgatctagaggagctgaagacccaca

SEQ ID NO: 1616 - DNA, 52 bp, Artificial Sequence
  Synthetic: Hsa349_ilmn_F
cactctttccctacacgacgctcttccgatctcacagggtgatgattgatgg

SEQ ID NO: 1617 - DNA, 56 bp, Artificial Sequence
  Synthetic: Hsa350_ilmn_F
cactctttccctacacgacgctcttccgatctgagaaggacttgataatctgtgga

SEQ ID NO: 1618 - DNA, 55 bp, Artificial Sequence
  Synthetic: Hsa351_ilmn_F
cactctttccctacacgacgctcttccgatctccgacagatagaagatcacttcc

SEQ ID NO: 1619 - DNA, 50 bp, Artificial Sequence
  Synthetic: Hsa352_ilmn_F
cactctttccctacacgacgctcttccgatctctgcatggccgacaagat

SEQ ID NO: 1620 - DNA, 56 bp, Artificial Sequence
  Synthetic: Hsa353_ilmn_F
cactctttccctacacgacgctcttccgatctttggatggaatactatttggaaca

SEQ ID NO: 1621 - DNA, 52 bp, Artificial Sequence
  Synthetic: Hsa354_ilmn_F
cactctttccctacacgacgctcttccgatctaccctgttcagtgctctgct

SEQ ID NO: 1622 - DNA, 54 bp, Artificial Sequence
  Synthetic: Hsa355_ilmn_F
cactctttccctacacgacgctcttccgatcttgcccatgactattctagcaac

SEQ ID NO: 1623 - DNA, 52 bp, Artificial Sequence
  Synthetic: Hsa356_ilmn_F
cactctttccctacacgacgctcttccgatctaacattgttgaaaggctggc

SEQ ID NO: 1624 - DNA, 52 bp, Artificial Sequence
  Synthetic: Hsa357_ilmn_F
cactctttccctacacgacgctcttccgatcttcaatcaaaggtggtctgga

SEQ ID NO: 1625 - DNA, 52 bp, Artificial Sequence; identical to SEQ ID NO: 1621
  Synthetic: Hsa358_ilmn_F

SEQ ID NO: 1626 - DNA, 52 bp, Artificial Sequence
  Synthetic: Hsa359_ilmn_F
cactctttccctacacgacgctcttccgatctgagagagagagaggcaggca

SEQ ID NO: 1627 - DNA, 52 bp, Artificial Sequence
  Synthetic: Hsa360_ilmn_F
cactctttccctacacgacgctcttccgatcttcactgcaccatagagacgc

SEQ ID NO: 1628 - DNA, 52 bp, Artificial Sequence
  Synthetic: Hsa361_ilmn_F
cactctttccctacacgacgctcttccgatctttggaggagagatgagggaa

SEQ ID NO: 1629 - DNA, 51 bp, Artificial Sequence
  Synthetic: Hsa362_ilmn_F
cactctttccctacacgacgctcttccgatcttcctgtgtgagtgctgcaa

SEQ ID NO: 1630 - DNA, 52 bp, Artificial Sequence
  Synthetic: Hsa363_ilmn_F
cactctttccctacacgacgctcttccgatctggaatcctgcacccactaaa

SEQ ID NO: 1631 - DNA, 59 bp, Artificial Sequence
  Synthetic: Hsa364_ilmn_F
cactctttccctacacgacgctcttccgatctgagagatgcaccttatttctctagtgt

SEQ ID NO: 1632 - DNA, 57 bp, Artificial Sequence
  Synthetic: Hsa365_ilmn_F
cactctttccctacacgacgctcttccgatctaaatttccaatagtttggagactca

SEQ ID NO: 1633 - DNA, 52 bp, Artificial Sequence
  Synthetic: Hsa366_ilmn_F
cactctttccctacacgacgctcttccgatctccagcaccacaggacataaa

SEQ ID NO: 1634 - DNA, 52 bp, Artificial Sequence
  Synthetic: Hsa367_ilmn_F
cactctttccctacacgacgctcttccgatctgactcaccaggccactcttc

SEQ ID NO: 1635 - DNA, 52 bp, Artificial Sequence
  Synthetic: Hsa368_ilmn_F
cactctttccctacacgacgctcttccgatctttgttcctccacctcattcc

SEQ ID NO: 1636 - DNA, 60 bp, Artificial Sequence
  Synthetic: Hsa369_ilmn_F
cactctttccctacacgacgctcttccgatctttcatcagaataccactattttcatttt

SEQ ID NO: 1637 - DNA, 60 bp, Artificial Sequence
  Synthetic: Hsa370_ilmn_F
cactctttccctacacgacgctcttccgatctttttcattttagttgctactctttgatt

SEQ ID NO: 1638 - DNA, 53 bp, Artificial Sequence
  Synthetic: Hsa371_ilmn_F
cactctttccctacacgacgctcttccgatcttgttgccttggtgagtcttct

SEQ ID NO: 1639 - DNA, 55 bp, Artificial Sequence
  Synthetic: Hsa372_ilmn_F
cactctttccctacacgacgctcttccgatctttatggagcttccatttagtggt

SEQ ID NO: 1640 - DNA, 56 bp, Artificial Sequence
  Synthetic: Hsa373_ilmn_F
cactctttccctacacgacgctcttccgatctaacagaagtgacagctttgagaac

SEQ ID NO: 1641 - DNA, 52 bp, Artificial Sequence
  Synthetic: Hsa374_ilmn_F
cactctttccctacacgacgctcttccgatctgccttgtcctcagccagtta

SEQ ID NO: 1642 - DNA, 52 bp, Artificial Sequence
  Synthetic: Hsa375_ilmn_F
cactctttccctacacgacgctcttccgatctatttaatcccatgggcctct

SEQ ID NO: 1643 - DNA, 52 bp, Artificial Sequence
  Synthetic: Hsa376_ilmn_F
cactctttccctacacgacgctcttccgatctccacaggagcacatcaagac

SEQ ID NO: 1644 - DNA, 52 bp, Artificial Sequence
  Synthetic: Hsa377_ilmn_F
cactctttccctacacgacgctcttccgatctgttcctgtattgcggcagag

SEQ ID NO: 1645 - DNA, 52 bp, Artificial Sequence
  Synthetic: Hsa378_ilmn_F
cactctttccctacacgacgctcttccgatctaagcaggtaccaagacacgc

SEQ ID NO: 1646 - DNA, 52 bp, Artificial Sequence
  Synthetic: Hsa379_ilmn_F
cactctttccctacacgacgctcttccgatctcaactccttgcttgggaagt

SEQ ID NO: 1647 - DNA, 52 bp, Artificial Sequence
  Synthetic: Hsa380_ilmn_F
cactctttccctacacgacgctcttccgatctaagggaatgcctccttccta

SEQ ID NO: 1648 - DNA, 58 bp, Artificial Sequence
  Synthetic: Hsa381_ilmn_F
cactctttccctacacgacgctcttccgatctctcctctttgaaacgattagtaatga

SEQ ID NO: 1649 - DNA, 57 bp, Artificial Sequence
  Synthetic: Hsa382_ilmn_F
cactctttccctacacgacgctcttccgatcttgatttcagaaagtctcaactacca

SEQ ID NO: 1650 - DNA, 52 bp, Artificial Sequence; identical to SEQ ID NO: 1621
  Synthetic: Hsa383_ilmn_F

SEQ ID NO: 1651 - DNA, 52 bp, Artificial Sequence; identical to SEQ ID NO: 1623
  Synthetic: Hsa384_ilmn_F

SEQ ID NO: 1652 - DNA, 52 bp, Artificial Sequence
  Synthetic: Hsa385_ilmn_F
cactctttccctacacgacgctcttccgatctggactggcaggtcaaggata

SEQ ID NO: 1653 - DNA, 52 bp, Artificial Sequence
  Synthetic: Hsa386_ilmn_F
cactctttccctacacgacgctcttccgatctggcaactattccagcttcca

SEQ ID NO: 1654 - DNA, 53 bp, Artificial Sequence
  Synthetic: Hsa387_ilmn_F
cactctttccctacacgacgctcttccgatctggtcctgcctagacacacatc

SEQ ID NO: 1655 - DNA, 52 bp, Artificial Sequence
  Synthetic: Hsa388_ilmn_F
cactctttccctacacgacgctcttccgatctcacttccaattcagcaagca

SEQ ID NO: 1656 - DNA, 52 bp, Artificial Sequence
  Synthetic: Hsa389_ilmn_F
cactctttccctacacgacgctcttccgatctgttgactttgagcaggaggc

SEQ ID NO: 1657 - DNA, 53 bp, Artificial Sequence
  Synthetic: Hsa390_ilmn_F
cactctttccctacacgacgctcttccgatctcacctgggtagtccttgatga

SEQ ID NO: 1658 - DNA, 59 bp, Artificial Sequence; identical to SEQ ID NO: 1631
  Synthetic: Hsa391_ilmn_F

SEQ ID NO: 1659 - DNA, 52 bp, Artificial Sequence
  Synthetic: Hsa392_ilmn_F
cactctttccctacacgacgctcttccgatctgtttccaagacatgatgggc

SEQ ID NO: 1660 - DNA, 53 bp, Artificial Sequence
  Synthetic: Hsa393_ilmn_F
cactctttccctacacgacgctcttccgatcttttcatcatagggctttgcac

SEQ ID NO: 1661 - DNA, 52 bp, Artificial Sequence
  Synthetic: Hsa394_ilmn_F
cactctttccctacacgacgctcttccgatctaagccatggagatcagagga

SEQ ID NO: 1662 - DNA, 52 bp, Artificial Sequence
  Synthetic: Hsa395_ilmn_F
cactctttccctacacgacgctcttccgatctttcccttgactttggcattt

SEQ ID NO: 1663 - DNA, 52 bp, Artificial Sequence; identical to SEQ ID NO: 1662
  Synthetic: Hsa396_ilmn_F

SEQ ID NO: 1664 - DNA, 52 bp, Artificial Sequence
  Synthetic: Hsa397_ilmn_F
cactctttccctacacgacgctcttccgatcttcttagggacacggctgact

SEQ ID NO: 1665 - DNA, 52 bp, Artificial Sequence
  Synthetic: Hsa398_ilmn_F
cactctttccctacacgacgctcttccgatctagatgtctgtggagagccgt

SEQ ID NO: 1666 - DNA, 52 bp, Artificial Sequence
  Synthetic: Hsa399_ilmn_F
cactctttccctacacgacgctcttccgatctaaatgttttggccttttgga

SEQ ID NO: 1667 - DNA, 52 bp, Artificial Sequence
  Synthetic: Hsa400_ilmn_F
cactctttccctacacgacgctcttccgatctcatgcgtgatgacgtagagg

SEQ ID NO: 1668 - DNA, 53 bp, Artificial Sequence; identical to SEQ ID NO: 1654
  Synthetic: Hsa401_ilmn_F

SEQ ID NO: 1669 - DNA, 52 bp, Artificial Sequence
  Synthetic: Hsa402_ilmn_F
cactctttccctacacgacgctcttccgatcttttaccacacaaagtgggca

SEQ ID NO: 1670 - DNA, 52 bp, Artificial Sequence; identical to SEQ ID NO: 1135
  Synthetic: Hsa403_ilmn_F

SEQ ID NO: 1671 - DNA, 54 bp, Artificial Sequence; identical to SEQ ID NO: 1622
  Synthetic: Hsa404_ilmn_F

SEQ ID NO: 1672 - DNA, 52 bp, Artificial Sequence; identical to SEQ ID NO: 1642
  Synthetic: Hsa405_ilmn_F

SEQ ID NO: 1673 - DNA, 52 bp, Artificial Sequence; identical to SEQ ID NO: 1613
  Synthetic: Hsa406_ilmn_F

SEQ ID NO: 1674 - DNA, 52 bp, Artificial Sequence; identical to SEQ ID NO: 1613
  Synthetic: Hsa407_ilmn_F

SEQ ID NO: 1675 - DNA, 52 bp, Artificial Sequence
  Synthetic: Hsa408_ilmn_F
cactctttccctacacgacgctcttccgatctcccatcaagccaactctcat

SEQ ID NO: 1676 - DNA, 52 bp, Artificial Sequence
  Synthetic: Hsa409_ilmn_F
cactctttccctacacgacgctcttccgatctcaaccaatgaaaccaaggct

SEQ ID NO: 1677 - DNA, 54 bp, Artificial Sequence
  Synthetic: Hsa410_ilmn_F
cactctttccctacacgacgctcttccgatctcaagacaaaaatccaacaagca

SEQ ID NO: 1678 - DNA, 54 bp, Artificial Sequence
  Synthetic: Hsa411_ilmn_F
cactctttccctacacgacgctcttccgatctggctaagggcacaagagaatta

SEQ ID NO: 1679 - DNA, 52 bp, Artificial Sequence
  Synthetic: Hsa412_ilmn_F
cactctttccctacacgacgctcttccgatctagccctgtactaccagcgtg

SEQ ID NO: 1680 - DNA, 52 bp, Artificial Sequence
  Synthetic: Hsa413_ilmn_F
cactctttccctacacgacgctcttccgatctaaacctttggttggatgctg

SEQ ID NO: 1681 - DNA, 52 bp, Artificial Sequence
  Synthetic: Hsa414_ilmn_F
cactctttccctacacgacgctcttccgatctagttgcccatggtcacaaat

SEQ ID NO: 1682 - DNA, 52 bp, Artificial Sequence
  Synthetic: Hsa415_ilmn_F
cactctttccctacacgacgctcttccgatctctgctgccagaaatggagtc

SEQ ID NO: 1683 - DNA, 60 bp, Artificial Sequence
  Synthetic: Hsa416_ilmn_F
cactctttccctacacgacgctcttccgatctgggatatttggttagttgatttgatatt

SEQ ID NO: 1684 - DNA, 60 bp, Artificial Sequence; identical to SEQ ID NO: 1637
  Synthetic: Hsa417_ilmn_F

SEQ ID NO: 1685 - DNA, 52 bp, Artificial Sequence
  Synthetic: Hsa418_ilmn_F
cactctttccctacacgacgctcttccgatctttcttgtcaggccctacacc

SEQ ID NO: 1686 - DNA, 52 bp, Artificial Sequence
  Synthetic: Hsa419_ilmn_F
cactctttccctacacgacgctcttccgatctctccaggaagcctacgtgat

SEQ ID NO: 1687 - DNA, 51 bp, Artificial Sequence
  Synthetic: Hsa420_ilmn_F
cactctttccctacacgacgctcttccgatctcccagagcctcagagaagg

SEQ ID NO: 1688 - DNA, 51 bp, Artificial Sequence; identical to SEQ ID NO: 1687
  Synthetic: Hsa421_ilmn_F

SEQ ID NO: 1689 - DNA, 52 bp, Artificial Sequence
  Synthetic: Hsa422_ilmn_F
cactctttccctacacgacgctcttccgatctttacccaggacagagtgcct

SEQ ID NO: 1690 - DNA, 52 bp, Artificial Sequence
  Synthetic: Hsa423_ilmn_F
cactctttccctacacgacgctcttccgatctacctccactctcaggcttca

SEQ ID NO: 1691 - DNA, 53 bp, Artificial Sequence
  Synthetic: Hsa424_ilmn_F
cactctttccctacacgacgctcttccgatctaaacagagtgaaaggcagtcg

SEQ ID NO: 1692 - DNA, 52 bp, Artificial Sequence
  Synthetic: Hsa425_ilmn_F
cactctttccctacacgacgctcttccgatctccacgggaatggagagatta

SEQ ID NO: 1693 - DNA, 52 bp, Artificial Sequence; identical to SEQ ID NO: 1662
  Synthetic: Hsa426_ilmn_F

SEQ ID NO: 1694 - DNA, 52 bp, Artificial Sequence; identical to SEQ ID NO: 1633
  Synthetic: Hsa427_ilmn_F

SEQ ID NO: 1695 - DNA, 52 bp, Artificial Sequence
  Synthetic: Hsa428_ilmn_F
cactctttccctacacgacgctcttccgatcttcatcctgagcactctgtgg

SEQ ID NO: 1696 - DNA, 52 bp, Artificial Sequence
  Synthetic: Hsa429_ilmn_F
cactctttccctacacgacgctcttccgatctgcctcaggctgtctgaactc

SEQ ID NO: 1697 - DNA, 52 bp, Artificial Sequence
  Synthetic: Hsa430_ilmn_F
cactctttccctacacgacgctcttccgatctcagaagccctgatgtgtcct

SEQ ID NO: 1698 - DNA, 52 bp, Artificial Sequence; identical to SEQ ID NO: 1697
  Synthetic: Hsa431_ilmn_F

SEQ ID NO: 1699 - DNA, 52 bp, Artificial Sequence; identical to SEQ ID NO: 1675
  Synthetic: Hsa432_ilmn_F

SEQ ID NO: 1700 - DNA, 53 bp, Artificial Sequence; identical to SEQ ID NO: 1660
  Synthetic: Hsa433_ilmn_F

SEQ ID NO: 1701 - DNA, 52 bp, Artificial Sequence
  Synthetic: Hsa434_ilmn_F
cactctttccctacacgacgctcttccgatctagaacaagggaggagctggt

SEQ ID NO: 1702 - DNA, 52 bp, Artificial Sequence
  Synthetic: Hsa435_ilmn_F
cactctttccctacacgacgctcttccgatctacaggtccttacgtgatggg

SEQ ID NO: 1703 - DNA, 52 bp, Artificial Sequence; identical to SEQ ID NO: 1630
  Synthetic: Hsa436_ilmn_F

SEQ ID NO: 1704 - DNA, 52 bp, Artificial Sequence; identical to SEQ ID NO: 1682
  Synthetic: Hsa437_ilmn_F

SEQ ID NO: 1705 - DNA, 52 bp, Artificial Sequence
  Synthetic: Hsa438_ilmn_F
cactctttccctacacgacgctcttccgatctccttgacttgatgcacctga

SEQ ID NO: 1706 - DNA, 53 bp, Artificial Sequence
  Synthetic: Hsa439_ilmn_F
cactctttccctacacgacgctcttccgatctaggagagtagaattgggctgg

SEQ ID NO: 1707 - DNA, 52 bp, Artificial Sequence; identical to SEQ ID NO: 1623
  Synthetic: Hsa440_ilmn_F

SEQ ID NO: 1708 - DNA, 48 bp, Artificial Sequence
  Synthetic: Hsa345_ilmn_R
ggagttcagacgtgtgctcttccgatcttaccagagagctcaggaggg

SEQ ID NO: 1709 - DNA, 48 bp, Artificial Sequence
  Synthetic: Hsa346_ilmn_R
ggagttcagacgtgtgctcttccgatctacagtctctgaatgggtcgc

SEQ ID NO: 1710 - DNA, 48 bp, Artificial Sequence; identical to SEQ ID NO: 1709
  Synthetic: Hsa347_ilmn_R

SEQ ID NO: 1711 - DNA, 48 bp, Artificial Sequence
  Synthetic: Hsa348_ilmn_R
ggagttcagacgtgtgctcttccgatcttaactggctgaggacaaggc

SEQ ID NO: 1712 - DNA, 48 bp, Artificial Sequence
  Synthetic: Hsa349_ilmn_R
ggagttcagacgtgtgctcttccgatctactcattcccagaacctgga

SEQ ID NO: 1713 - DNA, 50 bp, Artificial Sequence
  Synthetic: Hsa350_ilmn_R
ggagttcagacgtgtgctcttccgatctaaaagtcattgcatttccaaaa

SEQ ID NO: 1714 - DNA, 48 bp, Artificial Sequence
  Synthetic: Hsa351_ilmn_R
ggagttcagacgtgtgctcttccgatctccaacaccaaatgtttctgc

SEQ ID NO: 1715 - DNA, 50 bp, Artificial Sequence
  Synthetic: Hsa352_ilmn_R
ggagttcagacgtgtgctcttccgatcttgttcacctgtttcatctgagg

SEQ ID NO: 1716 - DNA, 48 bp, Artificial Sequence
  Synthetic: Hsa353_ilmn_R
ggagttcagacgtgtgctcttccgatctcagcaaccacacccatagtg

SEQ ID NO: 1717 - DNA, 48 bp, Artificial Sequence
  Synthetic: Hsa354_ilmn_R
ggagttcagacgtgtgctcttccgatctggttcagaagccctggaaat

SEQ ID NO: 1718 - DNA, 48 bp, Artificial Sequence
  Synthetic: Hsa355_ilmn_R
ggagttcagacgtgtgctcttccgatctagctggatccacatggtctt

SEQ ID NO: 1719 - DNA, 48 bp, Artificial Sequence
  Synthetic: Hsa356_ilmn_R
ggagttcagacgtgtgctcttccgatctaaggaatggtcctctgggag

SEQ ID NO: 1720 - DNA, 46 bp, Artificial Sequence
  Synthetic: Hsa357_ilmn_R
ggagttcagacgtgtgctcttccgatctccggaggtcccaaacagt

SEQ ID NO: 1721 - DNA, 48 bp, Artificial Sequence; identical to SEQ ID NO: 1717
  Synthetic: Hsa358_ilmn_R

SEQ ID NO: 1722 - DNA, 48 bp, Artificial Sequence
  Synthetic: Hsa359_ilmn_R
ggagttcagacgtgtgctcttccgatcttcagactcccagaattgggt

SEQ ID NO: 1723 - DNA, 48 bp, Artificial Sequence
  Synthetic: Hsa360_ilmn_R
ggagttcagacgtgtgctcttccgatctgtcagcatgatgtcagaggc

SEQ ID NO: 1724 - DNA, 47 bp, Artificial Sequence
  Synthetic: Hsa361_ilmn_R
ggagttcagacgtgtgctcttccgatctttgcagcactcacacagga

SEQ ID NO: 1725 - DNA, 48 bp, Artificial Sequence
  Synthetic: Hsa362_ilmn_R
ggagttcagacgtgtgctcttccgatctatctcttacgcccaaccctt

SEQ ID NO: 1726 - DNA, 48 bp, Artificial Sequence
  Synthetic: Hsa363_ilmn_R
ggagttcagacgtgtgctcttccgatctttgaatggcaaagggatagg

SEQ ID NO: 1727 - DNA, 56 bp, Artificial Sequence
  Synthetic: Hsa364_ilmn_R
ggagttcagacgtgtgctcttccgatctgtaaaggttgtaataccttccactaggt

SEQ ID NO: 1728 - DNA, 54 bp, Artificial Sequence
  Synthetic: Hsa365_ilmn_R
ggagttcagacgtgtgctcttccgatctaacatttggtagttgagactttctga

SEQ ID NO: 1729 - DNA, 48 bp, Artificial Sequence
  Synthetic: Hsa366_ilmn_R
ggagttcagacgtgtgctcttccgatctgatagccttcatcttgccca

SEQ ID NO: 1730 - DNA, 48 bp, Artificial Sequence
  Synthetic: Hsa367_ilmn_R
ggagttcagacgtgtgctcttccgatcttagcccacatgtccacattc

SEQ ID NO: 1731 - DNA, 48 bp, Artificial Sequence
  Synthetic: Hsa368_ilmn_R
ggagttcagacgtgtgctcttccgatctaactgctaatggcccgttct

SEQ ID NO: 1732 - DNA, 52 bp, Artificial Sequence
  Synthetic: Hsa369_ilmn_R
ggagttcagacgtgtgctcttccgatctatggtacttgattgctattccatt

SEQ ID NO: 1733 - DNA, 53 bp, Artificial Sequence
  Synthetic: Hsa370_ilmn_R
ggagttcagacgtgtgctcttccgatctttcactgaatatggtacttgattgc

SEQ ID NO: 1734 - DNA, 48 bp, Artificial Sequence
  Synthetic: Hsa371_ilmn_R
ggagttcagacgtgtgctcttccgatctgatgcaatgccaacttgaga

SEQ ID NO: 1735 - DNA, 55 bp, Artificial Sequence
  Synthetic: Hsa372_ilmn_R
ggagttcagacgtgtgctcttccgatctgctgatcttaaaatattactgacctgg

SEQ ID NO: 1736 - DNA, 48 bp, Artificial Sequence
  Synthetic: Hsa373_ilmn_R
ggagttcagacgtgtgctcttccgatctgagaggactgggaaatgcac

SEQ ID NO: 1737 - DNA, 48 bp, Artificial Sequence
  Synthetic: Hsa374_ilmn_R
ggagttcagacgtgtgctcttccgatcttggatgcaaggcatacacac

SEQ ID NO: 1738 - DNA, 47 bp, Artificial Sequence
  Synthetic: Hsa375_ilmn_R
ggagttcagacgtgtgctcttccgatctgcaacatccttcaattgcg

SEQ ID NO: 1739 - DNA, 48 bp, Artificial Sequence
  Synthetic: Hsa376_ilmn_R
ggagttcagacgtgtgctcttccgatctcatcctcccagcatgctcta

SEQ ID NO: 1740 - DNA, 48 bp, Artificial Sequence
  Synthetic: Hsa377_ilmn_R
ggagttcagacgtgtgctcttccgatctacctcagaggctgttcttgg

SEQ ID NO: 1741 - DNA, 51 bp, Artificial Sequence
  Synthetic: Hsa378_ilmn_R
ggagttcagacgtgtgctcttccgatctcttctttcgaatcccaaatacct

SEQ ID NO: 1742 - DNA, 48 bp, Artificial Sequence
  Synthetic: Hsa379_ilmn_R
ggagttcagacgtgtgctcttccgatctagggcagtacagcaggagaa

SEQ ID NO: 1743 - DNA, 48 bp, Artificial Sequence
  Synthetic: Hsa380_ilmn_R
ggagttcagacgtgtgctcttccgatctacctacctctcagccactgc

SEQ ID NO: 1744 - DNA, 54 bp, Artificial Sequence
  Synthetic: Hsa381_ilmn_R
ggagttcagacgtgtgctcttccgatctcttcatcaaatatgtcaccagaagtt

SEQ ID NO: 1745 - DNA, 50 bp, Artificial Sequence
  Synthetic: Hsa382_ilmn_R
ggagttcagacgtgtgctcttccgatcttgatagaagactcaccaaggca

SEQ ID NO: 1746 - DNA, 48 bp, Artificial Sequence; identical to SEQ ID NO: 1717
  Synthetic: Hsa383_ilmn_R

SEQ ID NO: 1747 - DNA, 48 bp, Artificial Sequence; identical to SEQ ID NO: 1719
  Synthetic: Hsa384_ilmn_R

SEQ ID NO: 1748 - DNA, 48 bp, Artificial Sequence
  Synthetic: Hsa385_ilmn_R
ggagttcagacgtgtgctcttccgatcttcactcctactgaggctggg

SEQ ID NO: 1749 - DNA, 48 bp, Artificial Sequence
  Synthetic: Hsa386_ilmn_R
ggagttcagacgtgtgctcttccgatctgttcatgcagcctcttgtcc

SEQ ID NO: 1750 - DNA, 51 bp, Artificial Sequence
  Synthetic: Hsa387_ilmn_R
ggagttcagacgtgtgctcttccgatctttccactgagtctgagtcttcaa

SEQ ID NO: 1751 - DNA, 48 bp, Artificial Sequence
  Synthetic: Hsa388_ilmn_R
ggagttcagacgtgtgctcttccgatctgaaaccctcagcgtctcagt

SEQ ID NO: 1752 - DNA, 48 bp, Artificial Sequence
  Synthetic: Hsa389_ilmn_R
ggagttcagacgtgtgctcttccgatctcacactgatgaagcgtgtcc

SEQ ID NO: 1753 - DNA, 48 bp, Artificial Sequence
  Synthetic: Hsa390_ilmn_R
ggagttcagacgtgtgctcttccgatctttgggaaagctggctacact

SEQ ID NO: 1754 - DNA, 56 bp, Artificial Sequence; identical to SEQ ID NO: 1727
  Synthetic: Hsa391_ilmn_R

SEQ ID NO: 1755 - DNA, 48 bp, Artificial Sequence
  Synthetic: Hsa392_ilmn_R
ggagttcagacgtgtgctcttccgatcttgccaatttaagagaacggg

SEQ ID NO: 1756 - DNA, 52 bp, Artificial Sequence
  Synthetic: Hsa393_ilmn_R
ggagttcagacgtgtgctcttccgatctagcagaagaggacagtaaacaatg

SEQ ID NO: 1757 - DNA, 48 bp, Artificial Sequence
  Synthetic: Hsa394_ilmn_R
ggagttcagacgtgtgctcttccgatctagaacaggcctcccaagttt

SEQ ID NO: 1758 - DNA, 48 bp, Artificial Sequence
  Synthetic: Hsa395_ilmn_R
ggagttcagacgtgtgctcttccgatctgtgaggacttggagctctgc

SEQ ID NO: 1759 - DNA, 48 bp, Artificial Sequence
  Synthetic: Hsa396_ilmn_R
ggagttcagacgtgtgctcttccgatctcaggcgtatctgtgtgagga

SEQ ID NO: 1760 - DNA, 48 bp, Artificial Sequence
  Synthetic: Hsa397_ilmn_R
ggagttcagacgtgtgctcttccgatctagcaggcttctcacttccag

SEQ ID NO: 1761 - DNA, 48 bp, Artificial Sequence
  Synthetic: Hsa398_ilmn_R
ggagttcagacgtgtgctcttccgatctattctgggagaccagcacac

SEQ ID NO: 1762 - DNA, 48 bp, Artificial Sequence
  Synthetic: Hsa399_ilmn_R
ggagttcagacgtgtgctcttccgatcttgcttgccagctctaatcaa

SEQ ID NO: 1763 - DNA, 48 bp, Artificial Sequence
  Synthetic: Hsa400_ilmn_R
ggagttcagacgtgtgctcttccgatcttcgcacacttaaggctaacg

SEQ ID NO: 1764 - DNA, 51 bp, Artificial Sequence; identical to SEQ ID NO: 1750
  Synthetic: Hsa401_ilmn_R

SEQ ID NO: 1765 - DNA, 48 bp, Artificial Sequence
  Synthetic: Hsa402_ilmn_R
ggagttcagacgtgtgctcttccgatctgaagtcggcctctctctcct

SEQ ID NO: 1766 - DNA, 48 bp, Artificial Sequence; identical to SEQ ID NO: 1192
  Synthetic: Hsa403_ilmn_R

SEQ ID NO: 1767 - DNA, 48 bp, Artificial Sequence
  Synthetic: Hsa404_ilmn_R
ggagttcagacgtgtgctcttccgatctgatccacatggtcttgaggg

SEQ ID NO: 1768 - DNA, 47 bp, Artificial Sequence; identical to SEQ ID NO: 1738
  Synthetic: Hsa405_ilmn_R

SEQ ID NO: 1769 - DNA, 48 bp, Artificial Sequence; identical to SEQ ID NO: 1709
  Synthetic: Hsa406_ilmn_R

SEQ ID NO: 1770 - DNA, 48 bp, Artificial Sequence; identical to SEQ ID NO: 1709
  Synthetic: Hsa407_ilmn_R

SEQ ID NO: 1771 - DNA, 48 bp, Artificial Sequence
  Synthetic: Hsa408_ilmn_R
ggagttcagacgtgtgctcttccgatctaccaaacacagcagggactc

SEQ ID NO: 1772 - DNA, 48 bp, Artificial Sequence
  Synthetic: Hsa409_ilmn_R
ggagttcagacgtgtgctcttccgatctacctctgttctgagccgcta

SEQ ID NO: 1773 - DNA, 48 bp, Artificial Sequence
  Synthetic: Hsa410_ilmn_R
ggagttcagacgtgtgctcttccgatctagagggtccagcctcaagat

SEQ ID NO: 1774 - DNA, 48 bp, Artificial Sequence
  Synthetic: Hsa411_ilmn_R
ggagttcagacgtgtgctcttccgatctggagtggcctctttgtgtgt

SEQ ID NO: 1775 - DNA, 48 bp, Artificial Sequence
  Synthetic: Hsa412_ilmn_R
ggagttcagacgtgtgctcttccgatctccaccctgacacataaaccc

SEQ ID NO: 1776 - DNA, 50 bp, Artificial Sequence
  Synthetic: Hsa413_ilmn_R
ggagttcagacgtgtgctcttccgatctaatgattgttggagtgctttca

SEQ ID NO: 1777 - DNA, 48 bp, Artificial Sequence
  Synthetic: Hsa414_ilmn_R
ggagttcagacgtgtgctcttccgatctgccaatgtttggagtctggt

SEQ ID NO: 1778 - DNA, 49 bp, Artificial Sequence
  Synthetic: Hsa415_ilmn_R
ggagttcagacgtgtgctcttccgatctttacccttgtgtgtgtctccc

SEQ ID NO: 1779 - DNA, 48 bp, Artificial Sequence
  Synthetic: Hsa416_ilmn_R
ggagttcagacgtgtgctcttccgatctatgcacctcattgtttgtgc

SEQ ID NO: 1780 - DNA, 53 bp, Artificial Sequence; identical to SEQ ID NO: 1733
  Synthetic: Hsa417_ilmn_R

SEQ ID NO: 1781 - DNA, 48 bp, Artificial Sequence
  Synthetic: Hsa418_ilmn_R
ggagttcagacgtgtgctcttccgatctcatggtagagcagcatccag

SEQ ID NO: 1782 - DNA, 48 bp, Artificial Sequence
  Synthetic: Hsa419_ilmn_R
ggagttcagacgtgtgctcttccgatctccgtatctcccttccctgat

SEQ ID NO: 1783 - DNA, 48 bp, Artificial Sequence
  Synthetic: Hsa420_ilmn_R
ggagttcagacgtgtgctcttccgatctgtttcgcgttttctggatgt

SEQ ID NO: 1784 - DNA, 48 bp, Artificial Sequence; identical to SEQ ID NO: 1783
  Synthetic: Hsa421_ilmn_R

SEQ ID NO: 1785 - DNA, 48 bp, Artificial Sequence
  Synthetic: Hsa422_ilmn_R
ggagttcagacgtgtgctcttccgatctctcatttggcagcctcagac

SEQ ID NO: 1786 - DNA, 48 bp, Artificial Sequence
  Synthetic: Hsa423_ilmn_R
ggagttcagacgtgtgctcttccgatctgacttctgtgtgttccgtgg

SEQ ID NO: 1787 - DNA, 48 bp, Artificial Sequence
  Synthetic: Hsa424_ilmn_R
ggagttcagacgtgtgctcttccgatcttgtaaggagctggctgacct

SEQ ID NO: 1788 - DNA, 50 bp, Artificial Sequence
  Synthetic: Hsa425_ilmn_R
ggagttcagacgtgtgctcttccgatcttgcttgttggatttttgtcttg

SEQ ID NO: 1789 - DNA, 48 bp, Artificial Sequence; identical to SEQ ID NO: 1758
  Synthetic: Hsa426_ilmn_R

SEQ ID NO: 1790 - DNA, 48 bp, Artificial Sequence; identical to SEQ ID NO: 1729
  Synthetic: Hsa427_ilmn_R

SEQ ID NO: 1791 - DNA, 48 bp, Artificial Sequence
  Synthetic: Hsa428_ilmn_R
ggagttcagacgtgtgctcttccgatctagccttaccctggcatcttt

SEQ ID NO: 1792 - DNA, 48 bp, Artificial Sequence
  Synthetic: Hsa429_ilmn_R
ggagttcagacgtgtgctcttccgatctagctggaggtagtggagcaa

SEQ ID NO: 1793 - DNA, 48 bp, Artificial Sequence
  Synthetic: Hsa430_ilmn_R
ggagttcagacgtgtgctcttccgatctggcctcagaatccacaaaga

SEQ ID NO: 1794 - DNA, 48 bp, Artificial Sequence; identical to SEQ ID NO: 1793
  Synthetic: Hsa431_ilmn_R

SEQ ID NO: 1795 - DNA, 48 bp, Artificial Sequence; identical to SEQ ID NO: 1771
  Synthetic: Hsa432_ilmn_R

SEQ ID NO: 1796 - DNA, 52 bp, Artificial Sequence; identical to SEQ ID NO: 1756
  Synthetic: Hsa433_ilmn_R

SEQ ID NO: 1797 - DNA, 48 bp, Artificial Sequence
  Synthetic: Hsa434_ilmn_R
ggagttcagacgtgtgctcttccgatctctctgccgcaatacaggaac

SEQ ID NO: 1798 - DNA, 47 bp, Artificial Sequence
  Synthetic: Hsa435_ilmn_R
ggagttcagacgtgtgctcttccgatctgtttcactgggctctgacg

SEQ ID NO: 1799 - DNA, 48 bp, Artificial Sequence; identical to SEQ ID NO: 1726
  Synthetic: Hsa436_ilmn_R

SEQ ID NO: 1800 - DNA, 49 bp, Artificial Sequence; identical to SEQ ID NO: 1778
  Synthetic: Hsa437_ilmn_R

SEQ ID NO: 1801 - DNA, 48 bp, Artificial Sequence
  Synthetic: Hsa438_ilmn_R
ggagttcagacgtgtgctcttccgatctcccagcctgcttctgattta

SEQ ID NO: 1802 - DNA, 48 bp, Artificial Sequence
  Synthetic: Hsa439_ilmn_R
ggagttcagacgtgtgctcttccgatctgaagtgcctgaaacccaaag

SEQ ID NO: 1803 - DNA, 48 bp, Artificial Sequence; identical to SEQ ID NO: 1719
  Synthetic: Hsa440_ilmn_R

SEQ ID NO: 1804 - DNA, 8729 bp, Artificial Sequence
  Synthetic: NLS-Cas3-10aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggggggcagcggaagtagtggcgggagtgggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1805 - DNA, 8750 bp, Artificial Sequence
  Synthetic: NLS-Cas3-17aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggctgacccaactaacagagctaagggcctggaggccgtatctgtggcatcacagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1806 - DNA, 8789 bp, Artificial Sequence
  Synthetic: NLS-Cas3-30aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1807 - DNA, 8819 bp, Artificial Sequence
  Synthetic: NLS-Cas3-40aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggagcggctcaagtggtggaagcggctcaagtcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1808 - DNA, 8729 bp, Artificial Sequence
  Synthetic: NLS-nCas3-10aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggctgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggggggcagcggaagtagtggcgggagtgggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1809 - DNA, 8750 bp, Artificial Sequence
  Synthetic: NLS-nCas3-17aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggctgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggctgacccaactaacagagctaagggcctggaggccgtatctgtggcatcacagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1810 - DNA, 8789 bp, Artificial Sequence
  Synthetic: NLS-nCas3-30aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggctgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1811 - DNA, 8819 bp, Artificial Sequence
  Synthetic: NLS-nCas3-40aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggctgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggagcggctcaagtggtggaagcggctcaagtcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1812 - DNA, 8729 bp, Artificial Sequence
  Synthetic: NLS-dCas3-10aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgccatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggggggcagcggaagtagtggcgggagtgggcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1813 - DNA, 8750 bp, Artificial Sequence
  Synthetic: NLS-dCas3-17aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgccatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggctgacccaactaacagagctaagggcctggaggccgtatctgtggcatcacagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1814 - DNA, 8750 bp, Artificial Sequence; identical to SEQ ID NO: 1813
  Synthetic: NLS-dCas3-30aa-FokI

SEQ ID NO: 1815 - DNA, 8819 bp, Artificial Sequence
  Synthetic: NLS-dCas3-40aa-FokI
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatgccacccccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgccatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagagcggctccgaaacgccgggtacatccgagtccgcgactcctgagtcaggaggcagcggctcctctggtggaagcggctcaagtggagggagcggctcaagtggtggaagcggctcaagtcagctggtgaagtccgagctggaggagaagaagagcgagctgcgccacaagctgaagtacgtgccccacgagtatatcgagctgatcgagatcgccaggaatcctacccaggatcgcatcctggagatgaaagtgatggagttctttatgaaggtgtacggctataggggagagcacctgggaggcagccgcaagcctgacggcgccatctacacagtgggctccccaatcgactatggcgtgatcgtggataccaaggcctacagcggcggctataacctgccaatcggacaggcagacgagatgcagcggtacgtggaggagaaccagacaagaaataagcacatcaacccaaatgagtggtggaaggtgtatccctcctctgtgaccgagttcaagtttctgttcgtgtccggccactttaagggcaactacaaggcccagctgacacggctgaatcacatcaccaactgtaatggcgccgtgctgtctgtggaggagctgctgatcggcggcgagatgatcaaggccggcaccctgacactggaggaggtgagaaggaagtttaacaatggcgagatcaatttctaacattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1816 - DNA, 5169 bp, Fusobacterium nucleatum
atgggccccaagaagaagagaaaggtaggcagcggcatggagaagagagtgtacggcatcctgggcatcagctccatcatgtccaattggaacgccgatttctctggcgagcctaagtctatcagcaatggcagaatctttggctccgacaaggccttcaagtacccaatgaagaagatgtgggagaaccagggcgagaaggtgctgtatatcaagtctctgaaggtggataagggcgccctgatccccaagaccctgaaggagaggtacgagcagctgtttcctgagaagaagctggataagaacaccgagacaatcgaagtgatcaagaatctgttcaaggccatcgacgtgaagaactttggcgccaccttcgccgaggagggcaacaatatcagcatcacaggcgccgtgcagatcggccagggcttcaacttttacgacgagagcaataccgaggtgcaggatatcctgtcccccttcagagaccctaagggcaagatcaacaaggagacaaaggagaacgaggatgccaagaatagcaccctgggcacaaagatcgtgtccgacgaggcccactacttttatccattcaatatcaaccccctggcctacaaggagtttatcgagctggagatcaccgatggctacacagaggaggactatctgaagttcaaggaggccgccctgtctagcgccaccttctttgccacaaactccaaagtgggctgcgataatgagtttggcctgttcatcgagaccgaggaggacttttacctgccaatcctgacacagtatatcaagttcgagaagggcgaggagaagaacaagatcaccctgaatctgtctacaatcctgaagggcgtggagaaccacatcaagaatatcgagatctactataatcccgtgaccacagagatcgtgaccgatatcagcaactacaagctgatcaatatcctgacaaagaaggaagtgggctctggcgagggaaggggcagcctgctgacctgtggcgacgtggaggagaaccctggacctcctaaaaagaaacgaaaggtaggctctggcatggaggtgtacgagatgaagctgaaggtgaagctgaagaaggatatctttctgaaggacgtgagcacctatatcacaagattcatggatatgaacctgtccgccaatccaaccatgtacaactatcacacatctaagatctacaagggctatacctttgacggcctgttccccatcgaggaggataagatctacaagaaggacaagacctatagctttcgggtgagaacaatcaaccagaagatcgccaattacttcctggataccctgatgttctttgagaataaggacatccagggcctgacactgaacatcagagtgatcgagaagaagctgatcgagaagctgtacaccatcacacctatcctgatgaagaccgatgagggctactggcggtattctatgacatttgaggagttcgagaagagactgaagatcaactgcctgaagaagtacctgtatttcaccgagaacaatgacgatatcaccatcgacacagagctgctgaagaagctgggcgaggataagagcgacgatatcgacctgtttacaaacatcaagttcatcaataggatgcccgtgcctatcatctacaagggccgcaagctggtgggcgataaggtggagctgcaggtggccaacaatgagaaggcccaggacatcgcctatatgctgctgggaaccggactgctggagaattgcgcacggggctgtggctttctgaacttcaagaattacgagggctccggcgagggaagaggctctctgctgacctgtggcgatgtggaggagaaccctggacctccaaagaagaaaagaaaagtcggctccggcatggaggccctgaagtttacactgagcggcaattccgccttctttaaggacaacgtgatcaataccgtgtacctgacatatggcaacatccacagggtggccctgctgggcatgtttggcgccatcctgggctacggcggctattctaagcagaacgacatgctgaagaagaagaacaagaagatgccagattaccccgagttctatgagaagctgaaggacatcaagatctctatcgtgagcaacggcaagaatggctactttaataagaagctgcagaccttcaacaatagcgtgggctatgcctccaaggaggagggcggcaatctgatcgtgaagcagttctggctggagaacccctcctgggatatctacatcctgctggactgcgatgaggccaagaagatcgccgactatatccagaaccgcaaggccatctacctgccttatctgggctccaacgatcacctggccaatatcatggatgtggagatcatcgacatcgaggagaagatgtcctctgaggacgagaccatcgagatcctgtctatggtgaaggactccgatatctctgagaagaagaagaacgtgttcagcatcgacaaaaatagcatccgggacgatatctacaagtattctgagtacctgcctgtgacactgagcaaggagctgaatcagtatgagaaggagaagatgaccatcacaaacatgagcgtgatcctgaagaagtcctactataaggtggaggataagaatatcgtgttctacggctctggcgaaggcagaggcagcctgctgacttgcggcgacgtggaagagaaccctggacctcccaagaaaaagaggaaagtgggcggctcccagctggtgaagtctgagctggaggagaagaagagcgagctgaggcacaagctgaagtacgtgccacacgagtatatcgagctgatcgagatcgccaggaaccccacccaggatcgcatcctggagatgaaagtgatggagttctttatgaaggtgtacggatataggggagagcacctgggaggcagcagaaagcctgacggagccatctacaccgtgggctccccaatcgattatggcgtgatcgtggacacaaaggcctactccggcggctataacctgccaatcggccaggccgacgagatgcagaggtacgtggaggagaaccagacccgcaataagcacatcaatcctaacgagtggtggaaggtgtatccaagctccgtgacagagttcaagtttctgttcgtgagcggccacttcaagggcaattacaaggcccagctgacccgcctgaaccacatcacaaattgcaacggagccgtgctgtccgtggaggagctgctgatcggcggcgagatgatcaaggcaggcaccctgacactggaggaggtgcggagaaagtttaacaatggcgagatcaacttctctgctagcgagacacctggcacctccgagtctgccaccccagagtccggcggctctggctctagcggcggctctggctcctccggaggaatgatcgatgaggccctggaggtgtttaagaagatctacgacaaggagggcgagaagctggtggtgaataagcacatccccaaggacggcacatatatcctggtgaatatcaagtctggcaagatcatcgagaagctgaacatcttctacgataagaagagcaagaagatcgacggcgagctgaaccagtactatggctattttcgcgccttcgattactatagcaacctggtggatatgaataagcctatggacccaaagaagaccatccacagcaatcagatctattccttctttatcaagaaggactctatccgggagaacaagctgacaaagagcatcatcgagggctacaagaagaacctgctgaatcctgaggagaagtacaattccaaggagggcaaggagctgtataagaacatcgccgagaagctgccaaagatcgagaaggatatcgtggaggacatcttcctgtggatcgaggacaatgtgaacgagaatctgctggagaacgataataagaaggactatctgaagatcttctttgtggaggaggacctggataagagcctggagctgtttaagaacgagcacaagaggtacatcatccctaacatcttcaactccaacgattacaataagaagatcggcgagaccatctatggcctgtctaacaataacatgggcctgaacgccaagaaggcctttctggagaataagaccaggcgcgtgagcacaccctacctggtgaatacagacgagatcctgctgcagtatgccttctacaactatctgctgcctgaggtgaagcagggcaactactttatctatttctccgagaatgagatcatcccaagaacctacaaggagggctgccccaacggcgccaagtacctgctgaatgcctcttatagcaaggacgtggatatcaagaactttaatgtgatctccaagaatagctccgaggagatcaacatcaatttcaaggagatcctgcaccagaagaagaaggacacagatgagatcgagtacggcaacctgaatagggagaagatgatgaacaacatcaacaagatcctgttttataactccctgctgggcaatttcctgctgtctgacggcgatctggacatcaaggatatcgagatcaagaagctgctgatgaagtaccgcaatgccttttacaagtggttctatctgaacgatgaggccgaggtgaagaagaatatcagaaagatctacctggacgccgtgatggtggccatcggcaacggctatttctttaaggccagccagcagctggactttggcttctgtctggagaagtacttctatggcaagtccgagctgatggaggagatcatgaacgtgaaagaggtgtttctgaatcacaccctgagcgaggaggattgggagttcctgaacgacgaggagtacttctttgccgtgggccagatcctggcctacatcaactatatgcgcaattccaaggccaagagcctgaacttcatcaagcagctgacattcgtgaagaacatcgacgtgctgaaggagaagatcaagaagatcgtgatctcctattctcacatctttgagaccaagaacaagaagatcaataggacagtgtctaacatcagcctgtaccagccaaaggagatccgcatcgatatcctgctggccggcttcaccgccgacatcatcttctttaagaagcgggaggagaagtga

SEQ ID NO: 1817 - DNA, 4791 bp, Klebsiella oxytoca
atgggccccaagaagaagagaaaggtaggcagcggcatggcaaaggcacccgtgtctgtgaagaccgccagcgtgctggcctttgagaggaagctggccacatccgacgccatgatgtacgccggcaactggctgggcgattcttggcagcctatcgagatcaaggagaaggccgtgaggggcaccatcagcaatcgcctgaagaacgccatcgcctccgacgccacaaagctggatgccgagatccagaaggcaaatctgcagcgggtggacaccgccgccctgccagccgacgccgataccctgaaggtggtgttcacactgagagtgctgggaaacctggcaaccccaagcgtgtgcaatgatatggcctaccagaacgccatccagcagacaatcgagggctatatcagcgagcacggatttgcagagctggcccggagatacgccgccaatctggccaacggcagattcctgtggcggaatagaatcggcgccgagcagatccaggtgtctgtgagcgcccagggacaggcctgggtgtttaacggccacgactattccctgagggagttctctcaggacgatgaggagatcgcctctctggccgccctgatcgagcagggactgagcggccaggcctgggtcatgctgaccgtggaggcacaggtgcggctgggagcaggccaggaggtgtttccatctcaggagctggtgctggatagcaatagctccaagtcccgcgtgctgtaccaggtggcaggaatcgcaggcatccacagccagaagatcggcaacgccctgcggacaatcgacacctggcaccccaaggtggatgagctgggagcaatcgcagtggagccttacggcagcgtgacctcccgcggaatggcatgcaggcagcccaaggacaagatggacttctacaccctgctggactcctgggtgacaaagggcatcaagcctgatgtggagcagcagcactacgtgatggccgtgctgatcaggggaggcgtgttcggcgagaagtctgagggcagcggcgagggaaggggcagcctgctgacatgtggcgacgtggaggagaaccctggacctcctaaaaagaaacgaaaggtaggcagcggcatggactacttcctggatatcagagtgctgccagaccccgagttttccgaggagatgctgatggccgccctgttcgccaagctgcacagagccctgggagcaaggggcaagggcgatatcggcgtgtcttttccagagttcagcgtgaagcctggaccactgctgaggctgcacggcgacgagtccgccctgtgcgccctggaggagaccctgtggagaaagggcctgaatgattattgtcagtctggccagatcatgcctgtggaggagatcaagggatggagatgcgtgagccgggtgcaggtgaagtctagcccagagaggctgatgaggcgcagcgtgcgcaagggatggctgacccaggacgaggcaaacgagcgcctgctgtccatgaggggagagtctacagccctgccttggctgaatatgaagtccctgtctaacggccagaagtttccactgttcatctgccacggagagctgctggcccagcgcgtggcaggcacctttaattcttacggcctgagccacatcgccacaatcccttggttcggctctggcgaaggcaggggcagcctgctgacctgtggcgatgtggaggagaaccctggacctccaaagaagaaaagaaaagtcggctccggcatgtcttacctgctgctgctgccccacatccgcatcgagaatgcaaacgcagtggcaggactgacctggggatttcctgccatcacacacttcctgggctatgtgcacgccctgtcccggagagtgtctgagtttggcgtgtccttcaccggctgcgccgtgatcaatcacgagcaccacatccaggcctactcctctggccgggactatcagtttgccctgacaagaaatcctctgaccaaggagggcaagacagccgccttcaacgaggagggcagaatgcacctgaccgtgagcctgctggtggagtgtcagggcgagatcatcaatggagagtacggcaaggccgccctgtgcagctccctgctgaccctgtgccagagccacaagctggccggaggctccatcgtgatgatgagggagccacagatctttaacgcccccgacgatgagaggaccctgcgcaagatcctgtggaggctgatgccaggattcgcactgtgcgataggtccgagtggctgatggagcactacaggcagctgcagcagaggcgccctgagtctagcctgctggacgcctggctggatttcgccgccatcaagtatcagcctgtgcagcaggagccagaggacagcatgtcctgggagtaccagcccaagcctaagccaggctatctggtgcccctgatgtgcggctaccagcggatcagcagactgtatcagccaggcgaggtggccaacgtgagggataccacaacccccttcgcctttaccgaggccgtgtacggagtgggagagtggagaggactgcacaggatcgccgacctggagccactgatctggaggtatcgcacatctgataccggctactattgcagcgccatgcccgtggccgacgatgacttcatctttaatgaggatgacgatctggagggctccggcgagggaaggggctctctgctgacctgcggcgacgtggaagagaaccctggacctcccaagaaaaagaggaaagtgggcggcagccagctggtgaagtccgagctggaggagaagaagtccgagctgaggcacaagctgaagtacgtgcctcacgagtatatcgagctgatcgagatcgcccggaatccaacacaggacagaatcctggagatgaaagtgatggagttctttatgaaggtgtacggatataggggagagcacctgggaggctctcgcaagccagatggagccatctacaccgtgggcagccccatcgactatggcgtgatcgtggatacaaaggcctacagcggcggctataacctgccaatcggacaggcagacgagatgcagcggtatgtggaggagaatcagaccagaaacaagcacatcaatcctaacgagtggtggaaggtgtacccatcctctgtgacagagttcaagtttctgttcgtgtccggccacttcaagggcaattataaggcccagctgacccgcctgaaccacatcacaaattgcaacggcgccgtgctgtctgtggaggagctgctgatcggcggcgagatgatcaaggcaggcacactgaccctggaggaggtgcggagaaagtttaacaatggcgagatcaatttctctgctagcgagacacctggcacctccgagtctgccaccccagagtccggcggctctggctctagcggcggctctggctcctccggaggaatgacaaccgaggccctgacacactttatcatcgactacatcgcctcccggaagcagccaaagctggatgccttcgagaaggaggccgccaagagactggcccagggagaggacgcaggagcaatcgcccaggagaggcaggagctggaggtgaagtatcagccaaggaactggctgaccgatgcagcaaggagggcaggacagatcagcctggtgacccacgccgccaagttcacacacggcgactccaagtcctctagcatctacagagagaccgtgggcgatgagggctatctgtccacagccgtgctggccaatgtggcagcagacgcagtgggaaacgcagccgccctggatgtggcaaagctgctgcagacagaagtgggaggcgacagcctgctggcctgtctgaagaggggcgatcgctccccactgatgggctttgccgagaatgacgcacagctggccctgtggatggagggcttctcccaggccctgaccccagcccagcctacatctcacaagctggccaagcagatctactttcctgtggatggcggctatcacctgctgagcccactgttcgcctcctctctggcccaggccatgcacgagaagatggtggcagcaaggtttggagagcaggcaaaggcagcaagagaggcaaggagagccggcaagtggcacgcacagccagacgtgcgctaccctaacgtggccgagatgcacttcggcggcaccaagccccagaatatctccgccctgaacagctcccggggaggcagagtgtggctgctgccctctcagccccctaagtggaccatgctggacaaggcccctcagaatctgacaagcctgtttgccctgagaggcgacttcaacagggccgccacagataccgtgagccggatggtgtccctgctgaaggagaagacagataacaataacaggcacatccgcaatgcaagggcaggatacgtggacgagctgatcgatctgctgtttctgcacgccgccacctatcagcaggaggcctggcagggctggacactgaactccccagacctgccactgcaccagcagctgtggctggacccctggaggtccaagacagatgagacctttagatctgagagggagaagggcgactggcagcgcagcgtggcagacgatttcgcaaggtggctgaattaccggctgaacaaggccagactggatgtgggaatcgcagagaggagggagtggcagacccagcggctgttcagccagcggatgagagagatggaggccatcgtgcaggaggccctgaagtga

SEQ ID NO: 1818 - DNA, 200 bp, Artificial Sequence
  Synthetic: Hsa414 single target guide template primer
cccagctggttctttccgaaaaaaacggtttatccccgctggcgcggggaactcgccgtagctgaaattggctgcaccatgtcggccggtttatccccgctggcgcggggaactcgccgtagctgaaattggctgcaccatgtcggccggtttatccccgctggcgcggggaactcggtgtttcgtcctttccacaagat

SEQ ID NO: 1819 - DNA, 8114 bp, Artificial Sequence
  Synthetic: Wild-type Cas3
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1820 - DNA, 8114 bp, Artificial Sequence
  Synthetic: Cas3 mutation variant 1 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccgcctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1821 - DNA, 8114 bp, Artificial Sequence
  Synthetic: Cas3 mutation variant 2 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggcgccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1822 - DNA, 8114 bp, Artificial Sequence
  Synthetic: Cas3 mutation variant 3 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccgccaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1823 - DNA, 8114 bp, Artificial Sequence
  Synthetic: Cas3 mutation variant 4 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaacacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1824 - DNA, 8114 bp, Artificial Sequence
  Synthetic: Cas3 mutation variant 5 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagaacgagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1825 - DNA, 8114 bp, Artificial Sequence
  Synthetic: Cas3 mutation variant 6 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctggaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1826 - DNA, 8114 bp, Artificial Sequence
  Synthetic: Cas3 mutation variant 7 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggaagaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1827 - DNA, 8114 bp, Artificial Sequence
  Synthetic: Cas3 mutation variant 8 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggataacgtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1828 - DNA, 8114 bp, Artificial Sequence
  Synthetic: Cas3 mutation variant 9 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcaggcgctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1829 - DNA, 8114 bp, Artificial Sequence
  Synthetic: Cas3 mutation variant 10 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggccagctgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1830 - DNA, 8114 bp, Artificial Sequence
  Synthetic: Cas3 mutation variant 11 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccagcacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1831 - DNA, 8114 bp, Artificial Sequence
  Synthetic: Cas3 mutation variant 12 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacaaacgccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1832 - DNA, 8114 bp, Artificial Sequence
  Synthetic: Cas3 mutation variant 13 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacgccaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1833 - DNA, 8114 bp, Artificial Sequence
  Synthetic: Cas3 mutation variant 14 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaatgggaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1834 - DNA, 8114 bp, Artificial Sequence
  Synthetic: Cas3 mutation variant 15 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcgccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1835 - DNA, 8114 bp, Artificial Sequence
  Synthetic: Cas3 mutation variant 16 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatccatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1836 - DNA, 8114 bp, Artificial Sequence
  Synthetic: Cas3 mutation variant 17 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatacggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1837 - DNA, 8114 bp, Artificial Sequence
  Synthetic: Cas3 mutation variant 18 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttcgccgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1838 - DNA, 8114 bp, Artificial Sequence
  Synthetic: Cas3 mutation variant 19 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgtcaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1839 - DNA, 8114 bp, Artificial Sequence
  Synthetic: Cas3 mutation variant 20 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgcccagtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1840 - DNA, 8114 bp, Artificial Sequence
  Synthetic: Cas3 mutation variant 21 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgacagcagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1841 - DNA, 8114 bp, Artificial Sequence
  Synthetic: Cas3 mutation variant 22 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccgcacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1842 - DNA, 8114 bp, Artificial Sequence
  Synthetic: Cas3 mutation variant 23 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacagcggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1843 - DNA, 8114 bp, Artificial Sequence
  Synthetic: Cas3 mutation variant 24 plasmid
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccctacttccaatccaatcgccaccatgcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcactccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaaattggaagtggataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1844 - protein, 888 aa, Artificial Sequence; identical to SEQ ID NO: 21
  Synthetic: Wild-type Cas3

SEQ ID NO: 1845 - protein, 888 aa, Artificial Sequence; identical to SEQ ID NO: 21
  Synthetic: Cas3 mutation variant 1 plasmid

SEQ ID NO: 1846 - protein, 888 aa, Artificial Sequence
  Synthetic: Cas3 mutation variant 2 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGAGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1847 - protein, 888 aa, Artificial Sequence
  Synthetic: Cas3 mutation variant 3 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSAKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1848 - protein, 888 aa, Artificial Sequence
  Synthetic: Cas3 mutation variant 4 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGNTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1849 - protein, 888 aa, Artificial Sequence
  Synthetic: Cas3 mutation variant 5 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKNETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1850 - protein, 888 aa, Artificial Sequence
  Synthetic: Cas3 mutation variant 6 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLEVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1851 - protein, 888 aa, Artificial Sequence
  Synthetic: Cas3 mutation variant 7 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVEEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1852 - protein, 888 aa, Artificial Sequence
  Synthetic: Cas3 mutation variant 8 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDNVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1853 - protein, 888 aa, Artificial Sequence
  Synthetic: Cas3 mutation variant 9 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQALGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1854 - protein, 888 aa, Artificial Sequence
  Synthetic: Cas3 mutation variant 10 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGQLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1855 - protein, 888 aa, Artificial Sequence
  Synthetic: Cas3 mutation variant 11 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPAQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1856 - protein, 888 aa, Artificial Sequence
  Synthetic: Cas3 mutation variant 12 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTNATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1857 - protein, 888 aa, Artificial Sequence
  Synthetic: Cas3 mutation variant 13 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHANSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1858 - protein, 888 aa, Artificial Sequence
  Synthetic: Cas3 mutation variant 14 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNGKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1859 - protein, 888 aa, Artificial Sequence
  Synthetic: Cas3 mutation variant 15 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCAIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1860 - protein, 888 aa, Artificial Sequence
  Synthetic: Cas3 mutation variant 16 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIHQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1861 - protein, 888 aa, Artificial Sequence
  Synthetic: Cas3 mutation variant 17 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDTVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1862 - protein, 888 aa, Artificial Sequence
  Synthetic: Cas3 mutation variant 18 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFAARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1863 - protein, 888 aa, Artificial Sequence
  Synthetic: Cas3 mutation variant 19 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHVRFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1864 - protein, 888 aa, Artificial Sequence
  Synthetic: Cas3 mutation variant 20 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHAQFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1865 - protein, 888 aa, Artificial Sequence
  Synthetic: Cas3 mutation variant 21 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDSREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1866 - protein, 888 aa, Artificial Sequence
  Synthetic: Cas3 mutation variant 22 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVAAQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1867 - protein, 888 aa, Artificial Sequence
  Synthetic: Cas3 mutation variant 23 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATAVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1868 - protein, 888 aa, Artificial Sequence
  Synthetic: Cas3 mutation variant 24 plasmid
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEHSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1869 - protein, 944 aa, Artificial Sequence
  Thermobifida fusca-Cas3
MPEHDSTDDKHGIPPLDLRFWAKERGLRGKTYPLVCHSLDAAAAALVLWNEYLSPGLRDTIASSMETDEEHAGHCIAFWAGLHDIGKLTREFQQQIAIDLSAYPGEELSGEQRSHAAATGKWLPFALPSLGYPNGGLVTGLVAQMLGGHHGTFHPHPSFQSRNPLAEFGFSSPHWEKQRHALLHAVFDATGRPTPPDMLDGPTASVVCGLVILADWLVSQEDFLLERLTSLPADGSASALRAHFETSLRRIPSLLDAAGLRPITVPPATFTESFPHLSKPNGLQASLAKHLPCLCTGPGLVLITAPMGEGKTEAAYHVADLLGKATGRPGRFLALPTMATADQMHTRLKEYARYRVENTDLPRSSTLALLHSMAWLNPDYAPADLPGVSKVLSNLGHRDPFAATDWLMGRKRGLLAPWAVGTIDQALMAVLRAKHNALRLFGLAGKVVVVDEAHAVDPYMQVLLEQLLRWLGTLDVPVVLLSATLHHSIANSLVKAYLEGARGRRWNRSEPQPVSEVSYPGWLHVDARIGKVTRSSDVDPLPIATTPRKPLEVRLVDVPVKEGALNRSTVLAKELTPLVKQGGCAAIICTTVAEAQGVYDLLSQWFATLGEDAPDLYLLHSRFPNRQRTEITATIVDLFGKEGAQSGRRPTRGAVLVATQVVEQSLDLDVDLMISDLAPVSLLLQRAGRCWRHEHLGIINRPQWAKQPELVVLTPEQNGDADRAPWFPRSWTSVYPLALLQRTYTLLRRRNGAPVQIPEDVQQLVDDVYDDDSLAEDLEADMERMGEELAQRGLARNAVIPDPDDAEDNLNGLTEFSFDVDEHVLATRFGAGSVRVLCYYVDTAGNRWLDPECTVEFPEQGTGREGRFTMADCRDLVARTIPVRMGPWASQLTEDNHPPEAWRESFYLRDLVLIPQRVTDEGAVLPTETGGREWLLDPCKGLIF

SEQ ID NO: 1870 - protein, 919 aa, Saccharomonospora viridis
MLLVDLRFWGKERGLEGARYPLVCHGLDAAAAVRWLWKRYLSARVRAGLAEAVGLTEEQTCRVLEFWAAAHDVGKLTPGFQEQVGVPEGYLPDSTGRRCRHEEASHIWLPSALTAVEHTTNSRNARLIAQMLGGHHGVFRRRDSADFRPGMFVHLGLGDSSWDLQRHAHLQAWRALLEPPTLPRRLSRHAAAVATGVVILADWLVSQIDYVRSRLPSLPEQGDLPSLSEFLSGSREATESVVRQAGLSRLRLRGGTFEEEFGFDEPNELQSSIAAELPGLLGNPGLLMIAAPTGFGKTEAALHAARLLSDAAGTSGMFFALPTMATSDEMFNRIARYVVRRAETGVAQSLLHGMAWLKPLRETLEQIHAEEGLSSDDETQVHGLEWLQGLKRAMLAPVGVGTIDQALLAVLPVRHNALRLFSLLGKTVVIDEVHAFSPYMRRLLCTLLGWLGEWNVPVVLLSATLPRNIAAELAAAYRGQNTGTPPDVPVPYPGWTYIERESGIKTRSVDFPRSHRRTLSVQLRPVAVARESGPDRLPVLREVLAPIVVDEGGGCALVLCTTVAEAQQTYRALRDWLGETDVDLRLLHARYPMHRRETLTAELMRAFGKPQHGDGGASHVGNRPAKAVVVATQVVEQSLDLDFDLVVSDLAPIELLLQRAGRLQRHSGWDPHRPAWADVSRGGQRRFIVLTAPDGDLHRLPRSWKFIYPPISLIRAHRLLAERAARGVRIPDDVQELVDRGNPGQFPDLDDPSVSGFTEEEIRRSAESLVETGTADSASIPVPKALTNLTDLSKGPLEEEQVTTRFNADSHRALPVFRTHDGALRLGGAHGEPLPVPREGKLSKDELKSIMKHTVPVPGSVVRGKDERHQLPEPWREITVLRDLVVLPHHIDEDGTVHPASVGGRKLLLDDVLGLLAVE

SEQ ID NO: 1871 - DNA, 10300 bp, Artificial Sequence; identical to SEQ ID NO: 381
  Synthetic: EcoCascade polycistronic plasmid

SEQ ID NO: 1872 - protein, 1638 aa, Artificial Sequence
  Synthetic: EcoCascade polycistronic plasmid
MPKKKRKVGSGEQKLISEEDLGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGSGEGRGSLLTCGDVEENPGPPKKKRKVGSGDYKDHDGDYKDHDIDYKDDDDKGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGSGEGRGSLLTCGDVEENPGPPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQGSGEGRGSLLTCGDVEENPGPPKKKRKVGSGGKPIPNPLLGLDSTGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPLGSGEGRGSLLTCGDVEENPGPPKKKRKVGSGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 1873 - DNA, 52 bp, Artificial Sequence
  Synthetic: Target specific primer
cactctttccctacacgacgctcttccgatctctcttccaaccacactgcag

SEQ ID NO: 1874 - DNA, 48 bp, Artificial Sequence
  Synthetic: Target specific primer
ggagttcagacgtgtgctcttccgatctggtttccaggttgccgtttt

SEQ ID NO: 1875 - DNA, 12850 bp, Artificial Sequence
  Synthetic: EcoCascade with Cas3-17aa-Cas8 fusion
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaatcctggacctcccaaaaaaaaacggaaggtgggctcaggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggctgacccaactaacagagctaagggcctggaggccgtatctgtggcatcaatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1876 - DNA, 12847 bp, Artificial Sequence
  Synthetic: EcoCascade with Cas8-17aa-Cas3 fusion
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaatcctggacctcccaaaaaaaaacggaaggtgggctcaggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggatcgggcaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggcgctgacccaactaacagagctaagggcctggaggccgtatctgtggcatcaatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagtaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1877 - DNA, 12850 bp, Artificial Sequence
  Synthetic: EcoCascade with Cas3-17aa-Cas5 fusion
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggctgacccaactaacagagctaagggcctggaggccgtatctgtggcatcaatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaatcctggacctcccaaaaaaaaacggaaggtgggctcaggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1878 - DNA, 12850 bp, Artificial Sequence
  Synthetic: EcoCascade with Cas5-17aa-Cas3 fusion
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggctgacccaactaacagagctaagggcctggaggccgtatctgtggcatcaatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggggtctggggaggggcgggggtctttgttgacttgcggggatgttgaggagaatcctggacctcccaaaaaaaaacggaaggtgggctcaggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1879 - DNA, 12850 bp, Artificial Sequence
  Synthetic: EcoCascade with Cas3-17aa-Cas6 fusion
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagggatccggagaaggaaggggatccctcctcacatgtggagatgtcgaagaaaatcctggacctcccaagaaaaagagaaaagtaggatcgggcatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaaggctgacccaactaacagagctaagggcctggaggccgtatctgtggcatcaatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1880 - DNA, 12850 bp, Artificial Sequence
  Synthetic: EcoCascade with Cas6-17aa-Cas3 fusion
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcagggatccggagaaggaaggggatccctcctcacatgtggagatgtcgaagaaaatcctggacctcccaagaaaaagagaaaagtaggatcgggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctggctgacccaactaacagagctaagggcctggaggccgtatctgtggcatcaatggagcccttcaagtacatctgccactattggggcaagagctccaagagcctgacaaagggcaacgacatccacctgctgatctaccactgcctggacgtggcagcagtggcagattgttggtgggaccagtctgtggtgctgcagaataccttttgtcggaacgagatgctgagcaagcagagagtgaaggcctggctgctgttctttatcgccctgcacgacatcggcaagttcgacatcaggtttcagtataagtccgccgagtcttggctgaagctgaatccagccacacccagcctgaacggcccttccacccagatgtgcaggaagttcaatcacggcgcagcaggactgtactggtttaaccaggactctctgagcgagcagtccctgggcgatttcttttctttctttgacgcagcacctcacccctacgagagctggttcccttgggtggaggcagtgacaggacaccacggctttatcctgcacagccaggaccaggataagtccaggtgggagatgccagccagcctggcctcctacgccgcacaggataagcaggcccgcgaggagtggatctccgtgctggaggccctgttcctgaccccagcaggactgtctatcaatgacatcccccctgactgctctagcctgctggccggcttttgttctctggccgactggctgggcagctggaccacaaccaatacattcctgtttaacgaggatgcaccatccgacatcaacgcactgcgcacctacttccaggataggcagcaggacgccagccgggtgctggagctgtccggcctggtgtctaataagcggtgctacgagggagtgcacgcactgctggataacggctatcagcccagacagctgcaggtgctggtggacgcactgcctgtggcaccaggactgacagtgatcgaggcacctaccggctccggcaagacagagaccgccctggcctatgcctggaagctgatcgatcagcagatcgccgactctgtgatcttcgccctgccaacacaggccaccgccaatgccatgctgaccaggatggaggcctccgcctctcacctgttttcctctcccaacctgatcctggcccacggcaacagccggttcaatcacctgtttcagtctatcaagagcagagccatcacagagcagggacaggaggaggcctgggtgcagtgctgtcagtggctgagccagtccaataagaaggtgttcctgggccagatcggcgtgtgcaccatcgatcaggtgctgatcagcgtgctgcctgtgaagcacaggtttatcaggggactgggaatcggccgctccgtgctgatcgtggatgaggtgcacgcctacgacacatatatgaacggcctgctggaggccgtgctgaaggcacaggcagacgtgggcggctctgtgatcctgctgagcgccaccctgccaatgaagcagaagcagaagctgctggatacatacggcctgcacaccgaccccgtggagaacaattctgcctatcctctgatcaattggaggggagtgaacggagcacagcggttcgacctgctggcccaccctgagcagctgccaccacggttttccatccagcccgagcctatctgcctggccgatatgctgccagacctgaccatgctggagagaatgatcgctgccgccaatgcaggagcacaggtgtgcctgatctgtaacctggtggatgtggcccaggtgtgctaccagcggctgaaggagctgaacaatacacaggtggacatcgatctgttccacgccaggtttaccctgaatgaccggagagagaaggagaaccgcgtgatcagcaacttcggcaagaatggcaagagaaacgtgggcagaatcctggtggccacacaggtggtggagcagtccctggacgtggatttcgactggctgatcacccagcactgccccgccgatctgctgtttcagcggctgggcagactgcacaggcaccaccgcaagtataggcctgcaggattcgagatcccagtggcaacaatcctgctgcctgacggagagggatacggccggcacgagcacatctatagcaatgtgcgcgtgatgtggcggacccagcagcacatcgaggagctgaacggcgccagcctgttctttccagatgcctacagacagtggctggactccatctatgacgatgccgagatggatgagcccgagtgggtgggcaatggcatggacaagttcgagtccgccgagtgtgagaagcggttcaaggccaggaaggtgctgcagtgggccgaggagtactctctgcaggataacgacgagacaatcctggccgtgacccgggacggagagatgagcctgccactgctgccttatgtgcagacaagctccggcaagcagctgctggatggccaggtgtacgaggacctgagccacgagcagcagtatgaggccctggccctgaacagggtgaatgtgcccttcacctggaagcggagcttcagcgaagtggtggatgaggacggcctgctgtggctggagggcaagcagaatctggatggctgggtgtggcagggcaactccatcgtgatcacatacaccggcgacgagggcatgaccagagtgatcccagccaaccccaagggatccggagagggcagaggaagtctgctaacatgcggtgacgtcgaggagaatcctggacctcccaagaaaaagagaaaagtaggatcgggcatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1881 - protein, 2488 aa, Artificial Sequence
  Synthetic: EcoCascade with Cas3-17aa-Cas8 fusion
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGSGEGRGSLLTCGDVEENPGPPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGSGEGRGSLLTCGDVEENPGPPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQGSGEGRGSLLTCGDVEENPGPPKKKRKVGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPLGSGEGRGSLLTCGDVEENPGPPKKKRKVGSGMEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPKADPTNRAKGLEAVSVASMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 1882 - protein, 2487 aa, Artificial Sequence
  Synthetic: EcoCascade with Cas8-17aa-Cas3 fusion
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGSGEGRGSLLTCGDVEENPGPPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGSGEGRGSLLTCGDVEENPGPPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQGSGEGRGSLLTCGDVEENPGPPKKKRKVGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPLGSGEGRGSLLTCGDVEENPGPPKKKRKVGSGNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNGADPTNRAKGLEAVSVASMEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1883 - protein, 2488 aa, Artificial Sequence
  Synthetic: EcoCascade with Cas3-17aa-Cas5 fusion
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGSGEGRGSLLTCGDVEENPGPPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGSGEGRGSLLTCGDVEENPGPPKKKRKVGSGMEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPKADPTNRAKGLEAVSVASMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQGSGEGRGSLLTCGDVEENPGPPKKKRKVGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPLGSGEGRGSLLTCGDVEENPGPPKKKRKVGSGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 1884 - protein, 2488 aa, Artificial Sequence
  Synthetic: EcoCascade with Cas5-17aa-Cas3 fusion
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGSGEGRGSLLTCGDVEENPGPPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGSGEGRGSLLTCGDVEENPGPPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQADPTNRAKGLEAVSVASMEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPKGSGEGRGSLLTCGDVEENPGPPKKKRKVGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPLGSGEGRGSLLTCGDVEENPGPPKKKRKVGSGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 1885 - protein, 2488 aa, Artificial Sequence
  Synthetic: EcoCascade with Cas3-17aa-Cas6 fusion
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGSGEGRGSLLTCGDVEENPGPPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGSGEGRGSLLTCGDVEENPGPPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQGSGEGRGSLLTCGDVEENPGPPKKKRKVGSGMEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPKADPTNRAKGLEAVSVASMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPLGSGEGRGSLLTCGDVEENPGPPKKKRKVGSGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 1886 - protein, 2488 aa, Artificial Sequence
  Synthetic: EcoCascade with Cas6-17aa-Cas3 fusion
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGSGEGRGSLLTCGDVEENPGPPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGSGEGRGSLLTCGDVEENPGPPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQGSGEGRGSLLTCGDVEENPGPPKKKRKVGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPLADPTNRAKGLEAVSVASMEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPKGSGEGRGSLLTCGDVEENPGPPKKKRKVGSGMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 1887 - DNA, 23 bp, Artificial Sequence
  Synthetic: sgRNA templating forward
agtaataatacgactcactatag

SEQ ID NO: 1888 - DNA, 82 bp, Artificial Sequence
  Synthetic: sgRNA templating oligo reverse
aaaaaagcaccgactcggtgccactttttcaagttgataacggactagccttattttaacttgctatttctagctctaaaac

SEQ ID NO: 1889 - DNA, 58 bp, Artificial Sequence
  Synthetic: Roadblock F1
taatacgactcactatagtggatatgggcgatgatctggttttagagctagaaatagc

SEQ ID NO: 1890 - DNA, 58 bp, Artificial Sequence
  Synthetic: Roadblock F2
taatacgactcactataggttgaagcccttctggatatgttttagagctagaaatagc

SEQ ID NO: 1891 - DNA, 58 bp, Artificial Sequence
  Synthetic: Roadblock F3
taatacgactcactatagagttgaagcccttctggatagttttagagctagaaatagc

SEQ ID NO: 1892 - DNA, 58 bp, Artificial Sequence
  Synthetic: Roadblock F4
taatacgactcactatagccgtgtagttgaagcccttcgttttagagctagaaatagc

SEQ ID NO: 1893 - DNA, 58 bp, Artificial Sequence
  Synthetic: Roadblock F5
taatacgactcactataggtcacaaatttggcgctgcagttttagagctagaaatagc

SEQ ID NO: 1894 - DNA, 58 bp, Artificial Sequence; identical to SEQ ID NO: 1893
  Synthetic: Roadblock F6

SEQ ID NO: 1895 - DNA, 58 bp, Artificial Sequence
  Synthetic: Roadblock R1
taatacgactcactataggatcatcgcccatatccagagttttagagctagaaatagc

SEQ ID NO: 1896 - DNA, 58 bp, Artificial Sequence
  Synthetic: Roadblock R2
taatacgactcactatagatcatcgcccatatccagaagttttagagctagaaatagc

SEQ ID NO: 1897 - DNA, 58 bp, Artificial Sequence
  Synthetic: Roadblock R3
taatacgactcactatagccagaagggcttcaactacagttttagagctagaaatagc

SEQ ID NO: 1898 - DNA, 58 bp, Artificial Sequence
  Synthetic: Roadblock R4
taatacgactcactatagacacggtgtttgactgtaaggttttagagctagaaatagc

SEQ ID NO: 1899 - DNA, 58 bp, Artificial Sequence
  Synthetic: Roadblock R5
taatacgactcactatagcagcgccaaatttgtgaccagttttagagctagaaatagc

SEQ ID NO: 1900 - protein, 888 aa, Artificial Sequence
  Synthetic: Eco-mCas3 (D452A)
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVAEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 1901 - protein, 2488 aa, Artificial Sequence
  Synthetic: nCas3-17aa-EcoCascade
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGSGEGRGSLLTCGDVEENPGPPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGSGEGRGSLLTCGDVEENPGPPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQGSGEGRGSLLTCGDVEENPGPPKKKRKVGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPLGSGEGRGSLLTCGDVEENPGPPKKKRKVGSGMEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVAEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPKADPTNRAKGLEAVSVASMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 1902 - DNA, 32 bp, Artificial Sequence
  Synthetic: TRAC 1 spacer
tctgtctgcctattcaccgattttgattctca

SEQ ID NO: 1903 - DNA, 32 bp, Artificial Sequence
  Synthetic: TRAC 2 spacer
taaggattctgatgtgtatatcacagacaaaa

SEQ ID NO: 1904 - DNA, 32 bp, Artificial Sequence
  Synthetic: TRAC 3 spacer
gattctgatgtgtatatcacagacaaaactgt

SEQ ID NO: 1905 - DNA, 32 bp, Artificial Sequence
  Synthetic: TRAC 4 spacer
tccatagacctcatgtctagcacagttttgtc

SEQ ID NO: 1906 - DNA, 32 bp, Artificial Sequence
  Synthetic: TRAC 5 spacer
agcaacagtgctgtggcctggagcaacaaatc

SEQ ID NO: 1907 - DNA, 32 bp, Artificial Sequence
  Synthetic: TRAC 6 spacer
tcagatttgttgctccaggccacagcactgtt

SEQ ID NO: 1908 - DNA, 32 bp, Artificial Sequence
  Synthetic: TRAC 7 spacer
gcgtttgcacatgcaaagtcagatttgttgct

SEQ ID NO: 1909 - DNA, 32 bp, Artificial Sequence
  Synthetic: TRAC 8 spacer
gtgtcttctggaataatgctgttgttgaaggc

SEQ ID NO: 1910 - DNA, 200 bp, Artificial Sequence
  Synthetic: TRAC 1 primer
cccagctggttctttccgaaaaaaacggttcatccccgcaggtgcggggaacactgagaatcaaaatcggtgaataggcagacagacggttcatccccgcaggtgcggggaacactgagaatcaaaatcggtgaataggcagacagacggttcatccccgcaggtgcggggaacacggtgtttcgtcctttccacaagat

SEQ ID NO: 1911 - DNA, 200 bp, Artificial Sequence
  Synthetic: TRAC 2 primer
cccagctggttctttccgaaaaaaacggttcatccccgcaggtgcggggaacacttttgtctgtgatatacacatcagaatccttacggttcatccccgcaggtgcggggaacacttttgtctgtgatatacacatcagaatccttacggttcatccccgcaggtgcggggaacacggtgtttcgtcctttccacaagat

SEQ ID NO: 1912 - DNA, 200 bp, Artificial Sequence
  Synthetic: TRAC 3 primer
cccagctggttctttccgaaaaaaacggttcatccccgcaggtgcggggaacacacagttttgtctgtgatatacacatcagaatccggttcatccccgcaggtgcggggaacacacagttttgtctgtgatatacacatcagaatccggttcatccccgcaggtgcggggaacacggtgtttcgtcctttccacaagat

SEQ ID NO: 1913 - DNA, 200 bp, Artificial Sequence
  Synthetic: TRAC 4 primer
cccagctggttctttccgaaaaaaacggttcatccccgcaggtgcggggaacacgacaaaactgtgctagacatgaggtctatggacggttcatccccgcaggtgcggggaacacgacaaaactgtgctagacatgaggtctatggacggttcatccccgcaggtgcggggaacacggtgtttcgtcctttccacaagat

SEQ ID NO: 1914 - DNA, 200 bp, Artificial Sequence
  Synthetic: TRAC 5 primer
cccagctggttctttccgaaaaaaacggttcatccccgcaggtgcggggaacacgatttgttgctccaggccacagcactgttgctcggttcatccccgcaggtgcggggaacacgatttgttgctccaggccacagcactgttgctcggttcatccccgcaggtgcggggaacacggtgtttcgtcctttccacaagat

SEQ ID NO: 1915 - DNA, 200 bp, Artificial Sequence
  Synthetic: TRAC 6 primer
cccagctggttctttccgaaaaaaacggttcatccccgcaggtgcggggaacacaacagtgctgtggcctggagcaacaaatctgacggttcatccccgcaggtgcggggaacacaacagtgctgtggcctggagcaacaaatctgacggttcatccccgcaggtgcggggaacacggtgtttcgtcctttccacaagat

SEQ ID NO: 1916 - DNA, 200 bp, Artificial Sequence
  Synthetic: TRAC 7 primer
cccagctggttctttccgaaaaaaacggttcatccccgcaggtgcggggaacacagcaacaaatctgactttgcatgtgcaaacgccggttcatccccgcaggtgcggggaacacagcaacaaatctgactttgcatgtgcaaacgccggttcatccccgcaggtgcggggaacacggtgtttcgtcctttccacaagat

SEQ ID NO: 1917 - DNA, 200 bp, Artificial Sequence
  Synthetic: TRAC 8 primer
cccagctggttctttccgaaaaaaacggttcatccccgcaggtgcggggaacacgccttcaacaacagcattattccagaagacaccggttcatccccgcaggtgcggggaacacgccttcaacaacagcattattccagaagacaccggttcatccccgcaggtgcggggaacacggtgtttcgtcctttccacaagat

SEQ ID NO: 1918 - protein, 1685 aa, Artificial Sequence
  Synthetic: PseCascade polycistronic plasmid
MGPKKKRKVGSGMTRFVQLHLLTSYPPANLNRDDLGNPKTARLGGVERLRVSSQSLKRAWRTSELFQQQLAGTIGTRTKRLGIEVFEALLGAGVTEKQAREWAGQIAKVYGAAKKDNPLEIEQLVHIAPEERASLDQLVATLAAEKRGPTDEELDALLHHQTAVDIAMFGRMLASKTQFNGEAAVQVAHAIGVHASAIEDDYFTAVDDLNRNDPGAAHIGESGFAAAVFYQYICIDRDLLKRNLGGDEVLTQKALRALTEAALKVGPSGKQNSFASRAFAHFALAEKGTDQPRSLSLAFVKPVAGTDYAGDAVAALQQVRDNMDKVYGVCAESRCQFNVLTGEGSVADLLDFVAAEGSGEGRGSLLTCGDVEENPGPPKKKRKVGSGMKPRKPRLNEAQQRWVRDWWRALQPRAEGDEPIPGELSVMGRGERAQLRRCTDADELLTQSATLLLAHRLVALNGERGPLPDNSLSYERMAWVAGVLANVKDDLRDGKSLATHLGQAADAERPPMSELRFRAMQRGTAMQELFLHWRRALQLAGGKTDVAHLADDLLSWQIEQGQSAAQASNGVKFHWAYDYYLSARDRAAAKEPEFNKEISKGSGEGRGSLLTCGDVEENPGPPKKKRKVGSGMTDYLLLRLYGPLASWGEIAVGESRHSAVQPSRSALLGLLGAALGIERHDDAAQQALVDGYRFAIKLECIGSPLRDYHTVQVGVPPRKFQFRSRRQELAADKVDTILSTREYRCDSLALVAVEALPGAPVDLASLAEALRKPRFALYLGRKSCPLALPLSPKILAASSVREVFDNLELPSLLGLLDRYQPEQAWPSRQDQQALRPGVARYYWEDGMTAGMAPSFEAQRHDQPLSRRRWQFAPRREWVALNDGGQSGSGEGRGSLLTCGDVEENPGPPKKKRKVGSGMSHYFSLVRLIGSPRHDAWLRDLSRHGEAYRDHALIWRLFPGDGAARDFVFRRLEDEKSFYVVSARPPQADAGLFHIQSKAYSPELAEGDWVRFDLRANPTVSVRRENGRSQRHDVLMHAKQLASTEKSALPERLEAAGREWLKDRAERWGLDLRTDSLMQNGYRQQRLKRKGKHIAFSTLDYQGIAQVTDPEQLRRALLDGVGHSKGFGCGLLLVKRVDGSGEGRGSLLTCGDVEENPGPPKKKRKVGGSMDLLSDTWLQCRHRDGTLKPIAIGQIGLEDCLELVAPRPDFRGALYQFLIGLLQTAYAPEDLQEWRDRYANPPTADDLAEVFAPYRDAFQLENSGPTFMQDLTLPDDVNQLPVLELLIDAGSSSNQYFNKPAVEHGMCEGCFTQALLTMQLNAPSGGRGIRTSLRGGGPLTTLLVPAEQNATLWQKLWLNVLPLDALDHPPIKMLSDVLPWLAPTRTSDDKQGQDTPPESVHPLQAYWSMPRRIRLDAATLDQGDCAVCGAQNVKRIRHYRTRHGGTNYTGTWTHPLTPYSLDSKGEKPPLSIKGRQAGRGYRDWLGLVLGNEDHQPDAAQVVRHFTAKLGKPSVRLWCFGFDMSNMKALCWYDSLLPVHGVAPDVQRKFTRSVKQVLDSANDMASVLHKQVKAAWFRRPGDAGQEPAVTQSFWQGSETAFYQVLEQLSKLDFDSAAELAAIYRAWLQATRRLVLSLFDHWVLSGPLEDMDMQRVVKARADLAKELNTGKAQKPLWTIVNQHLKEQA

SEQ ID NO: 1919 - protein, 911 aa, Artificial Sequence
  Synthetic: D448A Cas3 variant (mCas3)
MPNQASYFSYWGKASPLSQAGERFHLLPFHCLDVAACGQALISLPSFSLKPLAEELGWTQPQVESLFTFFLTLHDLGKFARAFQGLVPDLSPDLVPAEPGKCYDRRHDTLGWLLWSQDLAADDPIDNLPQPEHEFWAVWVRSVVGHHGKPPEEVADAGLTALELTDFFLRADRRAAREFVQALAGWMLPADLPVPDREQLKILRRHAWRLAGLAVLADWLGSNQGYFPYRSLPMSLPEYWELARQQAEHAVIASGLRWQPLRPWSNPLELFDYLREPTPLQAYAATVPLEHGPQLFLLEDVTGAGKTEAALILAQRLMQANLAHGLYFALPSMATANQMYQRVGGVYRRLYEPQAKPSLILSHGARQLIEGFRQSILQSAEQAEDCRYQPDEGSASVQCNAWLADNRKKALLAEVGVGTLDQALLAVLPARHQSLRLLGLAGKVLLVAEVHAYDPYMMTVLKTLLIAHARQGGSVILLSATLPLAAREELLAAYRFGLGVTAETVVDDRRYPLATQAGKSLNSHACETRPQLRRSVAVRPLHDEASVVELIVAQARVGRCVCWIRNTVDDARRANQLLAEHLPEEQRILFHSRFAMGHRLDIEAQVLARFGKASTGQVRAGQVLVGTQVLEQSLDFDVDLMVSDLAPVDLLIQRAGRLQRHARQASGDLAVDAVERREPPVLYLLTPEPVENPPADWYASLFPKACYVYPDAGRLWLGARALLQAGCIVTPGEQGQTGAVRELVEAVYGSEVDDVPNALKKASQDQLGKDMAMQSQAHFNGLRLDKGYCIDSSARWYEDHAVPTRLGDETQALYLALWTDGELQPLCADAAYPWEESAVRIAAHRARELAPDWQQQFAAPLEQLRNRYRLLEEPAFILPLVTSGTALVGKVLDEKGRVLDMRYDRQQGLSW

SEQ ID NO: 1920 - protein, 911 aa, Artificial Sequence
  Synthetic: D75A Cas3 variant (dCas3)
MPNQASYFSYWGKASPLSQAGERFHLLPFHCLDVAACGQALISLPSFSLKPLAEELGWTQPQVESLFTFFLTLHALGKFARAFQGLVPDLSPDLVPAEPGKCYDRRHDTLGWLLWSQDLAADDPIDNLPQPEHEFWAVWVRSVVGHHGKPPEEVADAGLTALELTDFFLRADRRAAREFVQALAGWMLPADLPVPDREQLKILRRHAWRLAGLAVLADWLGSNQGYFPYRSLPMSLPEYWELARQQAEHAVIASGLRWQPLRPWSNPLELFDYLREPTPLQAYAATVPLEHGPQLFLLEDVTGAGKTEAALILAQRLMQANLAHGLYFALPSMATANQMYQRVGGVYRRLYEPQAKPSLILSHGARQLIEGFRQSILQSAEQAEDCRYQPDEGSASVQCNAWLADNRKKALLAEVGVGTLDQALLAVLPARHQSLRLLGLAGKVLLVDEVHAYDPYMMTVLKTLLIAHARQGGSVILLSATLPLAAREELLAAYRFGLGVTAETVVDDRRYPLATQAGKSLNSHACETRPQLRRSVAVRPLHDEASVVELIVAQARVGRCVCWIRNTVDDARRANQLLAEHLPEEQRILFHSRFAMGHRLDIEAQVLARFGKASTGQVRAGQVLVGTQVLEQSLDFDVDLMVSDLAPVDLLIQRAGRLQRHARQASGDLAVDAVERREPPVLYLLTPEPVENPPADWYASLFPKACYVYPDAGRLWLGARALLQAGCIVTPGEQGQTGAVRELVEAVYGSEVDDVPNALKKASQDQLGKDMAMQSQAHFNGLRLDKGYCIDSSARWYEDHAVPTRLGDETQALYLALWTDGELQPLCADAAYPWEESAVRIAAHRARELAPDWQQQFAAPLEQLRNRYRLLEEPAFILPLVTSGTALVGKVLDEKGRVLDMRYDRQQGLSW

SEQ ID NO: 1921 - protein, 911 aa, Artificial Sequence
  Synthetic: D448A D75A Cas3 variant (dblmCas3)
MPNQASYFSYWGKASPLSQAGERFHLLPFHCLDVAACGQALISLPSFSLKPLAEELGWTQPQVESLFTFFLTLHALGKFARAFQGLVPDLSPDLVPAEPGKCYDRRHDTLGWLLWSQDLAADDPIDNLPQPEHEFWAVWVRSVVGHHGKPPEEVADAGLTALELTDFFLRADRRAAREFVQALAGWMLPADLPVPDREQLKILRRHAWRLAGLAVLADWLGSNQGYFPYRSLPMSLPEYWELARQQAEHAVIASGLRWQPLRPWSNPLELFDYLREPTPLQAYAATVPLEHGPQLFLLEDVTGAGKTEAALILAQRLMQANLAHGLYFALPSMATANQMYQRVGGVYRRLYEPQAKPSLILSHGARQLIEGFRQSILQSAEQAEDCRYQPDEGSASVQCNAWLADNRKKALLAEVGVGTLDQALLAVLPARHQSLRLLGLAGKVLLVAEVHAYDPYMMTVLKTLLIAHARQGGSVILLSATLPLAAREELLAAYRFGLGVTAETVVDDRRYPLATQAGKSLNSHACETRPQLRRSVAVRPLHDEASVVELIVAQARVGRCVCWIRNTVDDARRANQLLAEHLPEEQRILFHSRFAMGHRLDIEAQVLARFGKASTGQVRAGQVLVGTQVLEQSLDFDVDLMVSDLAPVDLLIQRAGRLQRHARQASGDLAVDAVERREPPVLYLLTPEPVENPPADWYASLFPKACYVYPDAGRLWLGARALLQAGCIVTPGEQGQTGAVRELVEAVYGSEVDDVPNALKKASQDQLGKDMAMQSQAHFNGLRLDKGYCIDSSARWYEDHAVPTRLGDETQALYLALWTDGELQPLCADAAYPWEESAVRIAAHRARELAPDWQQQFAAPLEQLRNRYRLLEEPAFILPLVTSGTALVGKVLDEKGRVLDMRYDRQQGLSW

SEQ ID NO: 1922 - protein, 933 aa, Thermomonospora curvata
MWGKRDGLPGPYPVVCHLIDTAAIAGALWDVWTAGLGVLRADVLGERVAAHMRSLVCFWAGLHDIGKVSPSFQVLVGDLYQKLVTEASEYEQDEAISGLRHNEVTQWVLVEIFRALGYPAADSARRDVGHQIAQLLGGHHGRFCAAMRRPELRAPRSRPGVGRGVWEEQCRAHAAVLRELTGAREVLRERLPVPVAVVVLGIVIVADWLASQESFIVARMPGEGWEASPEELRAHWERAVADAPQVVRDAGLGRGLLEDRTFRELFGFDEPNPLQASVMKELPELVNGPGLVLCTAPPGDGKTEAALYAAGVLARACGANGLGFCLPTMATTDAMHKRVSRFARRALREDAALTKVHSMAWLSSDAAGDAAAGAAGGDAVITDAEASTEAAQWLHAGRRGLLAPLTTFTIDQGLTGVLPVKYNVLRLMAMAGKVVVIDEAHSYDAWMHALLLRWLEWLGALRAPVILLSATLTGAAARSLVEAYLRGAGHTVPQELRPCYPGWLFADAVTGTVHPPREVTSERERAVAFEMVPVRRGKDPSRPGHRLAVIKDLLAQVVNGDRGCVLVCCTTVPEAQDTYRYLADWFRRVAEEGGRPPELRLLHSRYRARDRAAITEACERDFGKEGGRPRTVLVATQIVEQSLDLDFDLLITDLAPMALLLQRSGRCQRHRDGRIDLHRERRPDWAGAAPRVIVLNPVDDQGEFAVPEEWGGVYDESLLHRTSRLLHARGAEPVQIPGDVQALVDAVYAEDFTSVVALDEANARRIVRADGERLGGEAAQRQTADLVMICSPRDGKLRDLRNLSEAQAKVSSAWLTTRLGADSERLVCVYEQSPGVWTLDETGRIPVPGMEGRSRVTRDQARLIAEYMIPVPGRYCGEEAELLEPPPSWDKNAVLRDWKLLPMRRASDGGWYGRLRPGQVTYQANVGLQMLYP

SEQ ID NO: 1923 - protein, 953 aa, Streptomyces bottropensis
MGVREDARRDGINLSPWGKFDRGERAVYALLFHLLDVAALAGAVWDGYLTRGQRRLIAAGLGLTLAQARCQVMFIAGLHDLGKLSAFQEQEAHPWARVSDTLRSDTGNWRRMPHERASMHSVLHLLAEAGYPADTSDSPGVLIAQILGGHHGRFLQVDIDGAAKASRVNLALGGSAWQDVRRRYFALLRHLTGATAVPSDVSVPAAVLITGVGVIADRLASQRHYWLPKAQAPAFGAGEHFSLAVRDAPGVVEESGLVRITLPQVPFTQAHGGLERPNALQASMIGQLPAVVGEKGPGILVVTDATGGGKSVTALEAARIFNASGDTSGILWLLPTMATTDAAYDLLEAYVAAHHPEHAPVSLVHSHSYNNTAYTDHRLAAREPSTSDAYWPDSDDGYGDEGRPTAGERPEERVTVPDGWLRGWDRALLAQFTVATHDQALMAALPVRFSALRMLALCGRTVIVDEVHALPPFMRQTLSRLLHWLGALGCPVVLLSATLPGHISSQLVRSYLDGAGHPHPATAHLDCRPPYPGWLYAAASDASLTRIDPAAADAHADRHRRRADLRLHPVRHPSCTDPEDAPARESRLGRITQEIAPVARSGGCAAVYCATMADAQTTYAHLTTALNWPDGGPDGQLLLLHARLPGFQREALTRRVRTALSATGERPRRLVVITTSLLDMSLDVDVDVMVSDLAPLQTLLQRLGRLWRFDHIKRPDWLCGDVPRLIVLEPTDHRGRTLLPPAWRPLDSPFLPLATAAYLARRPEQPLTLPDDVQQLVEAVHGDADALARTDAALRRSHTLHQARTRTEEHHSALHLVPAWHDTLSLSDLHRQNLHPREAATRLGAMPRRLLPVYRMSGGRLTLDAAGTRPLPEHRKPTTAQIRTILQHTLPVPAAWVAGRTRDHHIPASWRSHALLADLVLLPQDAGDPSRPVRFGRHRLHLDDALGLVHTED

SEQ ID NO: 1924 - protein, 920 aa, Thermus thermophilus
MSVEEAALALWAKSGNPFHPLLAHMLDTAAVALAVLRMEPPRTRALYAEDWGLPEEGALAWAAALVGLHDLGKASPVFQAGWEEGKERVQRAGLPFGELLDWVAHGVFTELFLRRLLKEKGLPERAANDLAAALGAHHGFPANAEEKSRARRHLRTEDPLWKEARRWLLEEVFRRLGAPLPPSQGNGEARPEAVLRVMALASFADWVASDPSLFPYGRDPRRGDYLKEALRLAQEALNRLGWPAFAKAQRREFGELFPYIPKPNALQESVPALLEGACTPVLLLVEAPMGMGKTEAALYAHHLLQAGLGHRGLYVALPTQATANGLFPRVRGFLERLGEGSRLELQLQHGTALLNPHYAGLLERAAPRQVGEEEEGGAVASAWFSARKRAMLAPYGVGTLDQALLGVLRVKHHFVRLWGLMNRVVVLDEVHAYDVYTSGLLQALLRWLRALGSSAVVMTATLPPSRRRALLEAWAGEEVEGQDLGPYPRVVLVGEGVKARSLPPAREVEVALEVLREVDVEPLAQRLKGALPGAVGAIVNTVDRAQDLYRALGEGTPLTLEELARRLGGISGGQAWEEVRQALPERGGEVVGKVLTDGTLVFLLHARFPAEERALRGSVVLALFGKGGPRPPRAILVATQVAEQSLDLDFDLLYTDLAPIDLLFQRSGRLHRHERPRPEEHARPRLLLGVPEDLDFGKPLYWDKVYEDYVLLATWRALSGRDRLRVPGDLEALLEEIYEGENPESFPEGLRERAKKSLKALQERRDREANTARRLSLSELDRLLAYWDEGALVAQERLEDDEEKAETQRLLTRLGDPSVAVVPLFRVGEGLFLDREGRRRAPLKGEVSREEAEALFRRAVRLSRFPLPQELLKEEPPPAWRKSGLLRGLRPLEVGRVFRSGERAFQVELDPELGVVYLPV

SEQ ID NO: 1925 - protein, 981 aa, Streptomyces avermitilis
MGSVLVSVQVRMRCQWGLLCMAVMMKRESVSPGHVPVDTRFWGKEHGLPRPYPVLCHLLDTAGVFGALWDVLLSDQMREKVARALGLTVAEARRVLAFWAGLHDLGKITPPFQAQVPEAFAAVRNDPAYVFAPGAERERAFRHEMATHWALVQLLGEAGYPGGGRVMRSAVSHQVAQLLGGHHGCFGVVLKAKEVAHASAYQPGLGGDGWAVQRRAHFGELRRVTGGWAVPERGLPAELAVIVAGLVVVADWLASQEEAIIPLLPPKGWRATPEEVDMHWERTQKAAPGLVAGAQLGRARFDAEGFEEMFSFAPNALQADLVARLPRMVEEKGPGLLLVTAPTGDGKTEAALYAASVLGHAAGARGLFFALPTMATADAMYPRVSAFTERALSGERALTLLHSMAWLSPAYAGAGQSAGPPPAAGDVSADPATVTEAGVWLRGHRRGLLAPLGAGTIDQALSAVLPLTHNALRLFGLSDKVLVVDEAHAYGPWMHQLLSRLLEWLGAFGAPVVLLSATLSGRTASSLVDAYRRGAGFLEPSAVEPCYPGWMFTGAATGEVCVPRETDSERRRTLDVRMLPVVWDTAPAAGSPVCAGGRRQALREALEPVVAQSGTALVCCTTVAEAQQTFRDLRAAFPELSTGEGGLRLLHSRYPANTRQHITSACERAYGKPRSPQDVALPRPASVLVATQVVEQSLDLDFDLIVTDLAPLAQLLQRAGRGRRHARGASGRPPWALPEDAPRLVVLEPVGESGATQVPRTWGSVYDAGLLQRTAHLLRERAASGIAVPGDVQELIDAVYAEDFVDRLEGAVQRELARMDSARQADEAAEAHLADMVAICAPADVAGDLQRLSRREAGVTEELLTTRLGADSGRVLCLYEQQDNTLTLDEGGTLPLPTGNQNGLLHAELRQVMAHMAPVPGAWLRGAEGHPAPPGWGKHPVLRDLVLLRMQPAGQDGAAAVWSCRHGTRTIRISGVGLETS

SEQ ID NO: 1926 - DNA, 11587 bp, Artificial Sequence
  Synthetic: single-chain FokI fusion to EcoCascade
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatcgccaccatgcctaagaagaaaagaaaggttggatcgggcatgtcaaattttattaatattcatgttctgatcagtcatagcccgagttgcctgaatagagacgacatgaatatgcagaaagacgcaattttcggtggcaagaggcgagtccgaataagcagccaaagtcttaagcgagccatgaggaagagcggctattatgcccagaatatcggcgagtcctcattgcggaccatccacctcgcccagttgagagacgtcttgaggcagaaactgggggaaagattcgaccagaaaatcattgacaagacccttgccctccttagtgggaagagcgtggacgaggctgaaaaaatctctgccgacgccgtaacgccctgggttgtgggtgagattgcttggttttgtgaacaggtggcgaaggcggaggccgataacctggatgacaagaagctgctgaaggtccttaaggaggacatagctgccattcgggtcaatttgcagcagggagtggatatcgcattgtccggaagaatggctacatcaggcatgatgaccgagctgggcaaggtagacggagccatgagtatcgcacacgccatcaccacccaccaagtcgactcagacatcgactggttcacagcagtagatgacctccaggagcaggggtctgcccaccttgggacacaggagttctcttccggggtgttttatcgctatgctaatatcaatctggcgcagctgcaagaaaacctggggggagcctctcgagagcaggccctggagattgcaactcacgtcgtgcatatgcttgcgacagaggtacctggcgccaagcagaggacatacgctgcttttaatccagcagatatggtcatggtaaatttctctgatatgcctctctccatggccaacgcattcgagaaggcagtgaaggcaaaggacgggttcctgcagccatcaattcaagcgtttaatcagtattgggacagagtggcgaacggctatggactgaacggagccgcagctcagtttagcctcagcgatgtcgatcccataactgcacaggtgaaacagatgcctacgttggaacagctgaagtcatgggtaagaaataacggcgaagccggcagcggcgagggcagaggcagcctgctgacctgcggcgacgtggaggagaatcctggacctccaaaaaagaaaagaaaggtcggatcgggcatggccgacgagattgacgcaatggcactttaccgggcctggcagcagttggataatggttcatgtgcccagattcgcagagttagtgaacctgacgaactgagagatatccccgcgttttacagacttgtccaaccgttcggatgggagaacccacggcaccaacaagcactccttcgaatggtcttctgtttgtccgcaggaaaaaatgtaatcagacaccaagacaaaaagagcgagcaaaccacaggtatcagcctgggcagggcacttgccaactctgggcggatcaacgaaaggagaatttttcagctgatacgcgctgatcggactgcggacatggtgcagctgcgcagactccttactcatgccgaacctgtcctggattggcccctgatggcacgcatgctgacttggtggggaaagagagaaagacagcaactgcttgaagacttcgtgctcactacaaataagaatgccggatccggagaaggaaggggatccctcctcacatgtggagatgtcgaagaaaatcctggacctcccaagaaaaagagaaaagtaggatcgggcatgcggagctatctcatcctgagactggccggaccaatgcaggcctggggacagcctaccttcgaaggtacacgccccacaggccgctttcctaccaggagcggcctgctgggcctgcttggcgcttgtcttgggatccagcgcgatgatactagctccctgcaagcactgtcagagagcgtgcagtttgccgtaagatgcgacgaactgatccttgatgataggcgggtcagtgtcactggtctccgggactaccacacggtgctgggggcccgggaggattataggggcctgaaaagtcacgagacgattcaaacctggcgcgaatatctgtgcgatgccagcttcaccgtggccctgtggctgactccacatgccactatggtcatcagtgaactggaaaaggctgttcttaagcctcgatatactccgtatctgggccgccggagttgtccacttacacacccacttttcctcggcacctgccaggccagcgaccctcaaaaggcccttctgaattacgagccagttggcggtgacatatacagcgaagagtccgtgacgggacaccatcttaagttcaccgctcgggacgagcccatgattaccctcccacggcagttcgcatcaagggagtggtacgtcataaaggggggcatggatgtgagtcaggggtctggggaggggcgggggtctttgttgacttgcggggatgttgaggagaatcctggacctcccaaaaaaaaacggaaggtgggctcaggcatgtatctgtcaaaggttatcattgcacgcgcgtggagtagggatctgtatcagctgcaccagggtctgtggcatcttttcccgaaccgccccgacgcggcacgagactttctgtttcacgttgaaaaaagaaacacccccgagggctgtcatgtgctcctgcagtctgcccagatgccggtgagcacagctgtggcgactgtgatcaagaccaagcaggtcgagtttcagctccaggtaggggttccactgtattttcgcctgagagctaatccgatcaaaaccatactggataatcagaagaggctcgacagcaaaggaaatattaaaaggtgccgggtcccgctcatcaaagaggctgagcaaatcgcttggcttcaacggaaactggggaacgcagcccgcgtggaagacgtccacccgattagtgaacggccccaatatttttccggagacggaaagagcggcaagattcagacagtctgtttcgagggggtgctcaccatcaatgatgcccccgccctgatagacctggtgcagcagggcataggccccgctaaaagcatgggatgcggactgcttagtctggcaccgctgggatccggagagggcagaggaagtctgctaacatgcggtgacgtcgaggagaatcctggacctcccaagaaaaagagaaaagtaggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcgggggtggtggatctggaggtggcggatcgggaggtggcggatcgggaggtggcggatcgggaggtggcggatcgggaggtggcggatcgggaggtggcggatcgggaggtggcggatcgggaggtggcggatcgggaggtggcggatcgggaggtggcggatcgggaggtggcggatcgggaggtggcggatcgggaggtggcggatcgggcggcggcggctcacaattggtcaaaagcgaactggaagagaaaaaatctgagctcagacacaagctgaagtatgtgccccatgaatacatagaactcatagaaatagctcgaaaccccacgcaggaccggatccttgaaatgaaagttatggagttttttatgaaagtgtatgggtatcgaggagagcatcttggtggaagtcggaaaccggatggggcaatatacactgttgggagccccattgactatggtgtgatagtggacaccaaggcatacagcgggggatacaatctgccgatcgggcaggcagatgagatgcagcgctatgtggaggagaatcaaactaggaacaaacatattaacccaaacgaatggtggaaagtgtatccctcatctgttacggagttcaagttcctttttgtatctggccactttaaaggaaactataaagcacagctcacgcgacttaaccacatcaccaattgtaacggtgctgtactcagtgttgaggaactcctgatcggtggtgaaatgataaaagctggaaccttgacattggaggaagtaaggagaaagtttaataatggtgagatcaatttcgctgacccaactaacagagctaagggcctggaggccgtatctgtggcatcaatgaatttgctcattgataattggattccggtgcgcccccggaacggtgggaaagtgcagatcatcaatttgcaaagtctctactgttccagggaccagtggagactcagcctgccacgggatgatatggagctggcggcgttggctctgctcgtatgcatcggccagattattgcgccagcaaaggatgacgttgaattccggcatcggataatgaacccccttactgaagatgagttccagcagcttatcgccccatggatcgacatgttctacctcaaccacgccgagcatccttttatgcagaccaagggagtcaaggcgaatgatgtgactcccatggagaagctgctggccggtgtatctggggcgaccaactgcgcattcgtgaatcagcctggacagggggaggccctctgtggaggctgcactgctatagcactttttaaccaagctaatcaagcccccggctttggtggagggtttaagagtggattgagggggggcactcccgtaaccacttttgtgaggggaattgatctgaggtctactgtgttgctgaacgtcctcacactcccaaggctccagaagcagttcccaaacgaaagtcataccgaaaaccagcccacatggatcaagcccatcaaatctaatgagagcataccggctagcagtattggatttgtacggggtctgttctggcagccagctcacatcgagctgtgtgatcctattgggatcggcaagtgctcttgttgtgggcaggagtccaaccttaggtatactggatttctgaaagagaagtttacctttacagtaaatgggctctggccccacccccactcaccttgccttgtgacagtgaaaaagggggaagtcgaggagaagtttctggcctttacaacttctgccccttcctggactcagatttccagagtggtggtagataagataattcaaaacgagaatggcaatagagtggccgccgtggtgaaccagtttcgcaacatcgcccctcagtcccccctggagctgattatgggcggttatcggaataaccaggccagtatactcgagcgacggcacgatgtcctcatgttcaatcaaggttggcagcaatatggcaatgtgattaacgagatcgtaaccgtgggcctgggatataagaccgccctgcggaaggcgttgtatacttttgcagaaggctttaagaataaggattttaagggtgccggcgtgagtgtccatgaaacagctgaacggcacttttatcggcagtccgagctgttgataccagacgtgctggctaatgtgaacttctcacaggccgacgaagtgatcgctgatctgcgggataaactgcaccaactgtgcgagatgctgtttaatcaaagcgtcgctccttatgcccaccacccaaagctgatctccacgctggccctggcgcgcgccacactttataaacatctccgcgaactgaaaccccaggggggccccagcaatggctaataatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcattattattgaagcatttatcagggttattgtctcatgagcggatacatatttgaatgtatttagaaaaataaacaaataggggttccgcgcacatttccccgaaaagtgccacctgacgtc

SEQ ID NO: 1927 - protein, 2067 aa, Artificial Sequence
  Synthetic: single-chain FokI fusion to EcoCascade
MPKKKRKVGSGMSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEAGSGEGRGSLLTCGDVEENPGPPKKKRKVGSGMADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNAGSGEGRGSLLTCGDVEENPGPPKKKRKVGSGMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQGSGEGRGSLLTCGDVEENPGPPKKKRKVGSGMYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPLGSGEGRGSLLTCGDVEENPGPPKKKRKVGGSQLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFGGGGSGGGGSGGGGSGGGGSGGGGSGGGGSGGGGSGGGGSGGGGSGGGGSGGGGSGGGGSGGGGSGGGGSGGGGSQLVKSELEEKKSELRHKLKYVPHEYIELIEIARNPTQDRILEMKVMEFFMKVYGYRGEHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFADPTNRAKGLEAVSVASMNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

The invention claimed is:

1. An engineered Type I CRISPR-Cas effector composition comprising:
    a Type I CRISPR-Cas subunit protein;
    a Type I guide polynucleotide; and
    an engineered Type I CRISPR mCas3 (mCas3) protein, wherein the engineered mCas3 protein is selected from the group consisting of *Pseudomonas* sp. S-6-2 mCas3 proteins D448A mCas3, D75A mCas3, and D448A D75A mCas3.

2. The engineered Type I CRISPR-Cas effector composition of claim 1, wherein the *Pseudomonas* sp. S-6-2 mCas3 protein comprises SEQ ID NO: 1919.

3. The engineered Type I CRISPR-Cas effector composition of claim 1 further comprising a linker polypeptide covalently connecting the engineered mCas3 protein and the Type I CRISPR-Cas subunit protein.

4. The engineered Type I CRISPR-Cas effector composition of claim 1, wherein the Type I CRISPR-Cas subunit protein is selected from the group consisting of a Cas8 protein, a Cas5 protein, and a Cas7 protein.

5. The engineered Type I CRISPR-Cas effector composition of claim 4 further comprising a Type I CRISPR Cas6 protein.

6. The engineered Type I CRISPR-Cas effector composition of claim 4 further comprising a Type I CRISPR Cse2 protein.

7. A cell comprising the engineered Type I CRISPR-Cas effector composition of claim 1.

8. The cell of claim 7 further comprising a second engineered Type I CRISPR-Cas effector composition of claim 1.

9. The cell of claim 7 further comprising a donor polynucleotide.

10. The cell of claim 7, wherein the cell is a eukaryotic cell.

11. The eukaryotic cell of claim 10 wherein the cell is induced pluripotent stem cell.

12. A method of nicking double-stranded DNA (dsDNA) comprising:
    contacting a first nick site in a first target region in the dsDNA with a first engineered Type I CRISPR-Cas effector composition of claim 1
    thereby resulting in the first engineered Type I CRISPR-Cas effector composition binding the first target region and the first engineered mCas3 binding and nicking the dsDNA at the first nick site.

13. The method of claim 12 further comprising:
    contacting a second nick site in a second target region in the dsDNA with a second engineered Type I CRISPR-Cas effector composition of claim 1;
    thereby resulting in the second engineered Type I CRISPR-Cas effector composition binding the second target region and the second engineered mCas3 binding and nicking the dsDNA at the second nick site.

14. The method of claim 13, wherein the distance between the first nick site and the second nick site on the dsDNA is between 1 and 120 base pairs.

15. The method of claim 12, wherein the method is performed in vitro.

\* \* \* \* \*

UNITED STATES PATENT AND TRADEMARK OFFICE
CERTIFICATE OF CORRECTION

PATENT NO. : 12,227,776 B2  
APPLICATION NO. : 17/120081  
DATED : February 18, 2025  
INVENTOR(S) : Peter Sean Cameron et al.

Page 1 of 1

It is certified that error appears in the above-identified patent and that said Letters Patent is hereby corrected as shown below:

On the Title Page

Related U.S. Application Data  
Please delete "Continuation of application No. PCT/US2019/036864, filed on Jun. 12, 2019. Provisional application No. 62/684,735, filed on Ju. 13, 2018, provisional application No. 62/807,717, filed on Feb. 19, 2019."

And insert --Continuation of application No. PCT/US2019/036864 filed on 12 June 2019, which claims the benefit of U.S. patent application Ser. No. 16/420,061, filed 22 May 2019, now U.S. Pat. No. 10,457,922, issued 29 Oct. 2019, which is a continuation of U.S. patent application Ser. No. 16/262,733, filed 30 January 2019, now U.S. Pat. No. 10,329,547, issued 25 Jun. 2019, which is a continuation of U.S. patent application Ser. No. 16/104,875, filed 17 Aug. 2018, now U.S. Pat. No. 10,227,576, issued 12 Mar. 2019; and which claims the benefit of U.S. Provisional Patent Application Ser. No. 62/684,735, filed 13 Jun. 2018, and U.S. Provisional Patent Application Ser. No. 62/807,717, filed 19 Feb. 2019; the contents of which are herein incorporated by reference in their entireties.--

Attorney, Agent, or Firm should read:  
Attorney, Agent, or Firm  
Olga Zimmerman  
Barbara G. McClung Signed and Sealed this  
Thirtieth Day of September, 2025

John A. Squires  
*Director of the United States Patent and Trademark Office*